United States Patent 10,233,495 (METHODS AND COMPOSITIONS FOR SCREENING AND TREATING DEVELOPMENTAL DISORDERS) - sequence listing, part 32

SEQ ID NO: 303 - DNA, 583403 bp, Homo sapiens
aaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattata

SEQ ID NO: 304 - DNA, 440356 bp, Homo sapiens
ggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatgg

SEQ ID NO: 305 - DNA, 578687 bp, Homo sapiens
aaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatgg

SEQ ID NO: 306 - DNA, 5136 bp, Homo sapiens
ccaaattacttcttttctcaactgattaatcattcacgaaggttctacgtagagtccagcactgcttgaccccacttcttctccatagcctccaccaaccaccatgtgtttgccaggattctgtttgggtgaaaaataatcagatttgaggttgaaatatcaacctcaaactcctactgagaagtgaagataggtgcctgaagagaatatggagagaaagaaggcagtacaacagtgcaagccaacttttcagctgccttatttgtaagtcatgaactctctggttcacttgggggaatggctgagatgcacaatggagtttttggtccaagaatattattgtatttgaaattacaataattcataggacagtttctcaatctggaggcatttccacaggattggaggactcacatgaacagcatttcaatgctttggatttaaaagcagcaaaggcaatagaaggttaaatttaagcctcttctacaaagtgaatctgtgataagaaaatcaagaacaaacaggagctcaatggtaagccaactggctgctgagttaacaaaacagtaatcttatcatccaaatttgtgagggaacacataaatataacacttgagctgggaagccaagctttataaatagtatagattatgacagactacatgaaaacatggcagggaaaaatccaggggccccgagagacctcaagctaatctacaccagttttaaaatttaagaaaatagaaagtgagtatgactcaggctgccaaaagagaaaagtatagctggtgtgtctgaggtaagcctctttcatgttgcttctaaactacacactggtttacacaaattagaagggatgggagaagctagaaaaccaatcagaaaatatccctggggatcacatcaaggaggttctctgagaagaggttaaaaatggatttctttatcttttagcagtgaagactgagaggacatttatggatcttcaagtctatgaaggggtggaagcaggccagggcccctggaaagttggtgcctgtgtcacaaagtctctctcccattctgcttgtctatgctgaagaatgaaaagctattcaggcaacctcagggccacttctgtgtcaactgtgcagccagtactcgtcaagctatgacctggcctcggctcagcccagaacggggggctgagtctgcagaagttccagaccacccaggccgtgtcaatctcctcccttcagaggatcccaggggactggtttgaggttgggagatcccataggccttttggtctcagaactgatatgatgtgccaaaccacgctggaccccagtggacccccagtctttctgcatatccacaaagaacctcaggctcagccccaaatcaactctcattccaaggtggcatatctgtagcagcagtgaccatctctttctcatgattccactcacatccttcacagctattagaagaatctgtgttcccagaaattgttattaacaacaattaccagaaactcggtagtttgtatgaatgtatgtatgaatcaaacctaatttagtttctgtctcccccgactccaattccataagcaaggagacattacctttctatagttgcgtaagtcaaggtctatgcaactttatttatttatttagagacagagtctcactctgtcacccagactggagtgcagtggcatgatctcagctcactgcaacctccacctcccaggttcaagtgattctcctgcctcaccctcccgagtagctgagattacaagcgcccaccatcatgcccagctaatttttgtatttttagtagagatgggattttaccatgttggccaggctggtctcgaactcctgacctcaaatgatccacctcagcctcccaaagtgctgggattataggcggtctatgcaacttttaaaggcaataacacaaattaaggagggtgctactgaaagcttagctacattaagtttccgtttcttcttgggagcagattttgatgactctgattatctccaccctccagtgtgtattcagttcctgatgatttccttgccaattaaaaggcagaagagcctgtagtatgtgtaaggaaaggctaatgaaatccactgtgaaaatagatccgaatgcaacatgcaaaatgcatggtatttcaaactaccttgcaagagccctaaaaatgttcatatacttttgacctagtaaacctacttcagagactctatcctgataaagttttaagcccaaagccatttaatagtgaaacattatgaacaacctaaattgtagaagagctaagttatggttgagctaataattgaatattatttagtgattaaaaatgtttatcaagagtttttaatgacattgggaaaggattatgtcatgatatgttatgaaaaaaatcagcatacagaattacaccttcaatgttacttaacagatgtaaaaaataaaatatatggataaggaaacctgaaggaaatacaccaaaacgttcatatgagcggaggtagtgaaactacgggtgttttgatttcttgtttctacttttttgcatattctaaacttcctacaacaaataaacattactagagaataagataaatttctattgaaaagtgaaatggttgaatcagatgatttccaaggtccctttagctatattctgcaccatatccaataataatgtaaggggttgatgtttttatgactagtatagctttattaaaacaataacacattctggccagtattactgttggttgagtatattacttcatggccattaaactgcaaattccttaggggcagggactacccatactatgtagtaggcattcaataaatgtttatagaactgaatttaaatctggtaagtgaatgagacagcattagtggaattaattattggatgataacacatttgcttgcttgctttgacactgcagaattaccaaaatcattgctggttattttatattttggatagattttccctttataaaaacaatctgaagctggatgcagtggcttatgcctgtaatctcagcactttgagaggccaacgtgggaggatcacttgagcccacgagtttgagaccagccttggcaacatagtgagaacctgtctctacaaacaatgacaaaaaacaattagccaaatatagtggtcgtgcctatagtcccagctactcaggaggctgaggtgggagggtcgcttgagcccaggaggttgaggctgtagtgggccatgatcacaccactgtactccagcctgggcaacagggtaagaccttgtcttaaaaaaaaatggaaagaatagtcattgctacattttaaaaaccaggggttggaggttgggaggagggatgagtaggcagagcacagaagacagagcagtgaacacactctgaatgacagtatgatgatgaacaaatacctggcattatacatttttccaaacccacagaatgtataacaccaagagtggaccttgaggtaaactctgggactttgggtgattttgatgtgtcactgtaggtccatcacttgtaacaaatgtaccctctggtggaggatgatgataatggaggaggctgtgcatggggcgggaggggagcaaggagtatatgggaaatttctgagccttcttctatccaatttgctgtaaatctaaaactgcgcttagaaaaataaaagtcttataataacaaaaacaccaaccaaccaatcaatcagcaaaacaagcaaacaaataaacaaacctgacctttcatagaacatagtcttataactgaaaaatggtctagggttagtatgactttctaaaccacagtgtcagtttactgctacaaggtgatgaaatcacttatcatgaggtgacccttgggttgtctacatttcaggggtcataaggaagtaaagaagattcatcaaaattaagtttttatatttaattgatggaccaatactataaaaaggtgagacaccagtaaaagaattccaaacatgttttctggttgtagaatacctaaaccagtccagaaaatgccagatcatgtgtttttgaaataataagacagtgtgattcctttcatcttgctgtaggtgttccagatgagaaatagtgttaagattaactcatacaaaataaagccactattattagggataaggcatcgtggttgctaaaaacataaggagtcatccaaggctgaaagaaaccaaaagtgattgcagaagcgaaaagggttttaacttacttgaaagtaatgcaaagaattgctgcagaagccattccaaatgtgaaaaaaaaataatcaaagtgttcccatattattttggaggtcccacagcagctttgggttaaaatgatttaagtagtgggagaattcccaaattcaatttttcccaagcaaaataaaaatataaaattactctatctgggttaagcagaatcatacttcaccttaataaagaaatattctatctggtgccaatactttcctataactgaatttagtttcattcttttgtgtgggtagtgaaccaaaagaggggaggaatgtttacatcttggagacaggatagagaagagagatagctggaaaaggtgccagagaaaatctctgagggaacagccaccagcaaattccagaagcaccaacttcagatacaaagtgaatgccctggctgctgatgccagcaaaatatgccttggatgcattcttaatatctctccttgggatatgattatgagtgctgcaagttcatttggatctggcagtaatcgttgcaaggaaatgtcagtacaatgagatacttcggctactcccttgatattcatattaagggaatggcctagaccatacctatttaacttctaattttgcagagtatttcaaaggttaagtcacccttctatattagcagtaagttggatatattgtgttctatcagtggaagaggcatctgattttctttcatgctctttttggattcctgcattacatgtgtgtggtggtgattgtgtgtgtgtgcgtgtgtgtgtgtgtgtgtgtgtgtgtgtgtgtgtgtgtgtgtgtgaaggggcaggggagaggaggacaaaaatga

SEQ ID NO: 307 - DNA, 1203 bp, Homo sapiens
gcgcaactaaagaggaagtcggatgtcacatccaacggataaataaagacagcccggccacacaagagccgcattctgggcaggactcctgctaggtttggggaggggtcccagtctgcgatcctttctccctcttcgtgcagcgtcctcctccccggggcccgggccggcggcgcccacgcaacgcggcgcggtgcgagtcccgagagcacctcgagcccccggccccctccccagccccgccgggcccgcggccgccgcactcccgcacgccggctgcccagcgcccacgggccctgccccagactcgggcgcgcagttccgacggcccagggcggggacggcgcggcggaggggagctgccgccgcgggctctcggaggcaccggcggccgcacacagtcctccccttcgccgcgagtaaacagctcgcgggcgcgctccagccgcgcccccatccccccgccgggctccgcgccgccccgcgcccgcgcgtcccgcccgccggcgccgccgcccgctacctggtcggtgagtttgagcactgccattcttccgctccttcgcgcgcacacacatgcaggtccccggcccgcagatgtcacgccgggagccggggaagcggaagggattgccaggagaagggaaaaaatctggctcccgaatttgacagccctccccctgctcctcctccgccgccgcctcctcccgccgagaggctgacactggctagtggggtttgcagccgagcccgcccgcctttccacaggaagtaccggctgctgccagccgggccgccactgacatcaccgcgcgctggctcgctcgccgcccgccgcctgggccgacgctgcctcctgccgcccgcagccgagccgcgcagcccggcccccggcgctgcccccgcgcccgcaccgggccgccgcctgccttccgcacctgcacgcggcgcccggccgggccggccccgggccctgggcggatcgcgggcctccctgacgggtctcacacatatgggtggggaagcccgcggggacacaccccgagggggcaggaaaggctctcactcacatgccgtccactttaaccggggagatggggttacgcccccttcccctaacccagaatcaggtggtggcagcgccccgaagatcccagggaccgcaattatgatgctccctttgtttaatgccaggaggcagcg

SEQ ID NO: 308 - DNA, 43504 bp, Homo sapiens
gcgcaactaaagaggaagtcggatgtcacatccaacggataaataaagacagcccggccacacaagagccgcattctgggcaggactcctgctaggtttggggaggggtcccagtctgcgatcctttctccctcttcgtgcagcgtcctcctccccggggcccgggccggcggcgcccacgcaacgcggcgcggtgcgagtcccgagagcacctcgagcccccggccccctccccagccccgccgggcccgcggccgccgcactcccgcacgccggctgcccagcgcccacgggccctgccccagactcgggcgcgcagttccgacggcccagggcggggacggcgcggcggaggggagctgccgccgcgggctctcggaggcaccggcggccgcacacagtcctccccttcgccgcgagtaaacagctcgcgggcgcgctccagccgcgcccccatccccccgccgggctccgcgccgccccgcgcccgcgcgtcccgcccgccggcgccgccgcccgctacctggtcggtgagtttgagcactgccattcttccgctccttcgcgcgcacacacatgcaggtccccggcccgcagatgtcacgccgggagccggggaagcggaagggattgccaggagaagggaaaaaatctggctcccgaatttgacagccctccccctgctcctcctccgccgccgcctcctcccgccgagaggctgacactggctagtggggtttgcagccgagcccgcccgcctttccacaggaagtaccggctgctgccagccgggccgccactgacatcaccgcgcgctggctcgctcgccgcccgccgcctgggccgacgctgcctcctgccgcccgcagccgagccgcgcagcccggcccccggcgctgcccccgcgcccgcaccgggccgccgcctgccttccgcacctgcacgcggcgcccggccgggccggccccgggccctgggcggatcgcgggcctccctgacgggtctcacacatatgggtggggaagcccgcggggacacaccccgagggggcaggaaaggctctcactcacatgccgtccactttaaccggggagatggggttacgcccccttcccctaacccagaatcaggtggtggcagcgccccgaagatcccagggaccgcaattatgatgctccctttgtttaatgccaggaggcagcggacacattgtgattctttacagggtgtttgccaaacatttatgggtggagggaacagaagctctggcccttccaccttgttctccagccactttccagctaaacacacacacacatatgcacacacacatactattgttaaattcaaacaccctgggtttggtttttgctggtgggggtggagtggagttcctggagaagcaaagcagtcctaaatcaccgagttgatgggtcttttgggtgttcccaccagtccttactgatctctacaaaatcccaagttaccaagctcttcaacaaatagaagacagctgtcaaacaccatgggctacagatacaacgggcatattcgtaagcatagtagctgttgatagttctggaatttggagcaaacacttattcattgaacagctatgtactgagtccctaccttgtcaggcactggctaggcacgggaataaacggagagcataaataagataacctgctctcagaagatgccaacataaaccgcatagtctctgctaatgaatgtaattacaaactgagataagggatctcaagggaaaacatgcttctgaagtgaacccacaacaaaggaatcagaccagactggtgggtgagggcaggcttccctgagaaagtgacaggagttgagatctggagaagggagaattaagtaagcaagtggagaggaagtgctcccaggcagccccatgtgcccctggcaggccatagagcaaacctgtagggcagcattgaacagctttgaagagcaaactagagctacagaattctttggtcaagaccaaacatctgcctctactgtatattcacaaaccaaatgtccattcttcctccctactcttagaacctcccccaaagattccacatgagacaggagagaaaggagcattaatatcctcacatttaccatccagccactctggttgtcgaagcagctaaatctcaaatttacctttattagtcttatagattataattcagatcatgcagacaagaagaaccaaggaactttgttcctggcttccactcctctgttatcaatgttgcatggaaacaaacaaacaaaaaattctaaggcctttctcagacatacaacagattgtttatgttgcatctatgagtcagttcttcactgctgttattggtatgtctatttactgaacaccctgcatggctttgtaagtaaactgaataggaccctgcattctctacttaaatagagccatctttcagaagagtgataacaaatgacttaatttggaagattcactcaagatccaatttgattcatcgcggacatgcctgcacctaagttcctggggccaaagtgaggaggcagcagttctccacccaatcagaccatcatcctctttttgtaactagtatctttaacactccccttactatcctgaaaggtaatttgtggataatattacctaccaatacaaatttcaaaaaaaaaaaaaccagcaacaatatattgtcctaattgtacaataaaggaaaaattaaaggagagtaatttataatgaatatgtatttcagtaggtaagtggtaaaacacaactctctttgtcttctgacaaaacaaagcagtaagatgcttccacctatatggagaggctttgtgaatgagagaattacaaatgcagacagatgtgaacatatagtgttaggaattcaaatatcaagattggtgttgtcataggtgacctgactttgtgaaaggttgaacaactcgtggccaagttccaaataaaatagggagcagaagatttggcaaaatttattgataagactacacttatcagaaggtctgcttttaatgtgttagccagtactttgacagtgattcaaacactttgtttacttcattaaatgagactcagactcagcagttgactatattcggtgagcttgagaagccagaatgcccctggtataatgtagagaaagaaatccaaagatttgtggagatgggaatgttggaataattttatcatgtataatctgtacagccaacccctacatattcctggagagccagatgatgatctttatactgaagcattgaaaaatacaggccaggcaccatggcttatgcctataatcccagcactttgggaggctgaagcaggtggatcacctgaggtcaggagttccagaccagcctggctaacatggtgaaaccccgtctctactaaaaatacaaaaaattagccaggcgtggtggcatgcacctgtagttccagctacttgggaggctgagtcacgagagtcgcttgaacccaggaggcagaggttgcactgagccaatgacgcgccattgcactccagcctgggcaacaaagcaagactctgtcaaaaagaaaaaaaaagaaaaggaaagaaaaatacattcgagagagaacgtcagaaaaactctctagtagctggatatgatggtgggagatgctttcgttgagatggctccttgatttttatattagtgggatcctgcgacagcaatggccaagtggcagcacttagctggcagagacaaggtggacacatttactgtaatggacagcagagacaaagtagtacttaaaggtcttaacctacaggtatatctggcagtgccctaggttgtcctaggaatgaaatagacgggcagactttggaaatagccattgatctttataacagacaaaactctacatctgccacctgaaagctcccttgagccatcaaaatgaaattatctttcattcagtttccgtacctaaatgagttcacagacacagagctccttgattaaaagggaagctggtccccttcaggagggtcttgcagcattgtcataaatatatactacaaatcctcatccaagccttatccaaaggaacctgatgtatttttctaggctgagcgagtactgggaaaaaggaaatacccagacatttgagggatcactgacactgcttctgaattaatgctaattcctgaggattgcaaacaccactggatccaccaatcaaaatggggatctatggtaggtgataaatgaaatttttaactaagtataaatcagtgtggatccagtagctctgcagacccaaactatagttatctcctcaactgttagttagaatagacatactcagtaactaacagaatcctaacatcatttctctgacccacagagtgaagtttattatggtaagacaggccaaatggaagcctctggaatttcctcttgataccagaatagaaaaccaacaacaatgctcaatccctggaaatatgtagaaattggtaccaccagaaaagacgtagaagatacaggaatgataatactgtcacatctccatttaactcacctgttgggcctatgcaaaagatcttagagaataactatgatttgttattaagttgtaaacttaatcaaatggtaatgtcagttgcagctgctattctatatatgctgtctttaccgcaacaaagcaactcagccctaggcacctggtgtgcactattgatatggcaaatgctttttatctatttcaattttcaccaaaagttgttttcttttatatggcaagatcaacagtacacctttacagtcttctctaggggatgtaaacactcccactctctggcataatctcatctgcacaggtcttgatcactatgttaaagacatcgagctgactggccctgataaacaggaagtaacaaatattttagctgccttaacaacacacatgtgagccagagattgggtataaaccccaagaaaattcatcaccttagtgaagtttctggaggtccagtggtctagaaaacaccaggatattctccccaacgtaaaagacaaattacttcaccttgtaccatctaccactaagaaaagagacacaatactttctgggtatccttggattttagaggcaatatgtatcacatctgagtgtgatgctgtgacccatttatagagcaacccataaggctggaattttttattaggaataaggggagaagaaatatctgtagcaggacttgatgacccagaggaatccaatgatacttaaagtgtctgtggcaaataaggatgctatatagagcctctggtgagccctgattagatctacaatgcagaattccttagttgtagagcaagtcatgccctcttctgcagataacaattttctatttgaggaatggtccctagcttgctaagtgaatttgaatgactggccatgagacaatcaagtgactgcaagctcagctgcccattatgaactgagtgtaatctaatctaccaatccataagaccagacatacacaagaggaattcctcatcaaatggaaatggtatgtaagagactgagcttaagcaggtccagaaagcacaagttgccttagcaggtagctcagattcctttgatacttactcctggtgcctccttatcttcaacttcatggggaatttcttaagaccagttaactgatttacagacagttctcctaaatatactggcacaagctggaagtggtctattccagcatcacagtctcaataaggaatgcccccgatgacagtactgaagggaaattttctcagtgcaagaaatttccagcagcgcacctagggtctactttgtctggattgagagagacggtcaaaggtatagatctacactcattcacaggcaattattgatggttttgctgaatggtcagcaacttggaaagatgaggtggtccgggaaagaggtttgtgggtgcacctttcagaataggcacaaagtgtgaggaatttgtgtgccatgtgaatgctcaccacagagcatctactctgagaaggcttttagtaattaggtgaatgacacattcggtggagtgggcctctttctccacctattgcagtgcttgctcaaagtagccatggagtcaggaataaagactatgtttgggcttcaaatcttaggcttctctgcagtaaggctgatatctgacaacatcagaaatcacacattgagaggcaccatttccaagggagactagtcagccatgtggtagcaaattgattattttggaacccttccttcatggagggaacagttacttgtcttcactagagtagacacatattgtggatatgaatttgttttcttttcctttcttgttttttttttttttttcaggtagggtcttgctctgttgcccaggctggagtgcagtggcgtgatctcagctcactgcaatcactgcctcccagattcaagcgattctcgcacctcagcatcctgcatagctgggatcacaggagtgtgccactacgcccagctaatttttgtacttttagtagagacagggtttcatcatgttgactaggctggtctcaacccctggcctcaagtgatccacccatctcagcctcccaaagtgctaggattataggtgtaagcctccatgcccagctgatatggatttgtgcccagcgagtgtttcttttctttttggagatggagtctggctctgttgcccaggctggagtgcagtagcatgatctcggctcattgcaacctccacctccggggttcaagtgattctcctgcctcagcctccaaagtagctggaactacaggcatgcgccaccacacctggctaatttttacatttttagtagagatggggtttcaccatgttgaccaggctggtctcagaactcctcaccttaggtaatctgcctgctccgcctcccaaagtgcgggaattacaggcataagccaccatgcccggcccagagagtgtttctgacagaactaccatccatgacttatgttgtatcttactcactgttatatagtctacacaatattacttctttctgaggaactcatctcatggcaaaagaaatgcagcaaaggactcatgtaaatggaatttaccagtcttatcaatacctcatcagccagaagcagctcacctggaaggatgatggagttctactgaagactgagttccagcaccagctgggaaacaccacactaacatagtgaagttacctcttggaggacacagaaaatgctttgagtcaggagtcagtacatagtactgcttcccccaaaatacaaggtccaagaatcaagggtggggctgggagggagaagggagtggtggttgtagtagaagtggttcttttcatcattacacccaataatccactcatacagtttttgcttccagtgcctgttttgctttgagctctgctggtttgggggtgttgcttcccaagggagggttcccaccagggatcacaattatggtttcattgaattagaagctaagactgggatgtgtccactttcggttccacatgctatggaaacaacaggaaaagcaggggttacctttctgggtggggttactgattcccattatcaagaggaaattggtttgctacaacacagtgggaacagggaggacgatggggacagggaggacgattgggacaggaaggactatgttctggattttctgtggtaccccttagcacttccatatcctataataaaagttgatggaagctactataattttttaaaaggattaaaaaatggattcagacccttcaggagtgaagatatgaagagaagaaaagggcctctcttccaagcttttcgttctaataactaaccttttcccattgttcccagccctactggtggtagctgcttcttaaagttactatctctgtgttccctttttgttttttcagtcctctaacacctatttaaacaattccccatattaaacaggactatttaagcaattcctcatattaacccttttcttgtttagaaacaaaagtatagctgactgggcatggtggctcattcttgtaatcccagcattttaggaggccgaggcgggtggaccacttggggtcaggagttcaagaccagcctggctaacatggtgaaaccccatgtctactaaaaatacaaaaaaaaaaaaaaaaaaaaaaaattagctgggcgtggtggtatgcacctgtaatcccagttactagggaagctgaggcgggagaatcgtttgaatccaggaggcagaggttgtggtgagccgagatcgcaccattgcactctggcctgggcaacaagggcaaaactccatctcaacaacaacaacaaaacaaacaaacaaaaaaaaaaaagtatagctcactgcctgcactcatttgattttacataaacacgccctttgaggttgaagcaaatctgattttcaatgtgaaaataaaatctaaaaactgttcttggagttatttctaaacagaactaacatcaaaatcatctatttcagaaaaatcagattcatcaagtgactcttcagtcaacaactgttcaagaacgctgttaacatcacgtgtaggaatgctacgttttctagaatttgacattttcagcaatcgagaattactatattttgtaaacagaaatgccactactagaaacagaatgctataaatagaatgacgtcttttgttttcaaggtcaatatgtcagagcgatgcaaaaataataaaagtgagatatttcatggcaaagttatctcagggtaaacattgcatccacaagcgctgctggcgcatattctcggggcaaacgggaaagggttatttctgttaaaataatgtaggttgagccaggtgcagtgctcacacttgtaatcccagcactttgggaggctgaggctggcggatcacttgaggtcaagagttcaagaccagcctggtcaacatggtgaaaccccatctctactaaaaatacaaaaattagctccgtgtggtggtgggcacctgtaatcccagctacttgggaggctgaggcaggagaatcgtttgaacctgggaggtggaggttgcggtgagcagagatcatgacattgcactccagcctgggtaacagagcaagactccatctcaaaaaataataataatgtagattgttttcctgactagatcctgactgataccacaacacagttacattcctagaatgaaaaaaatctaaactaaactaaaacattgtgtttatatgtaaaacgggttaagttccaggctaagataattgcagacagatttttacctacatgaatatccagtgggacatttgaaagaccactttccaggacagctagcatctttaatttccaatcaatagatgcttgggcattccattctttgtgacaaccaaatatgttctctcaaatttcaaaaacattccctaaagagcaaggccgagaactgtgtactgtagtgaccatagcctatgactttactaaatctacccaatataccatatcacatttcgctatggttgttttatttacttgatgtatgcttttttaaattttataaatataaatgtgcacgtaaatgtgtgtgtatatctgtatatctgtgtttgtattttatatgtttatataaaacatatgtattagtccattctcatgctgctataaaggactgcccgtgactgggtagtttataaagaaaagagatttaattgactcacagttccacatggctggggagtcctcacaatcatggcagaagacaaaagaggagcaaagtcatgttttacatggtggcagggaagagagcttgtgtagggcaactcccctttataaaaccatcagctctcatgagacatattatccactatcatgagaacagcatgggaaagacccacccccatgattgaattacctcccaccaggtccctcccacgataagaggaaattataagagctacaatttaagatgagattttggtggggacacacccaaaccatatcaacatataaacttatgaatacacagtatttcactgtcgtggatgctgtagtgtgccacccagttcccacattcaggaccaaaggctttatgcccccaactgcagagagtgttgcctgctgatagcttgaagctgattcttccttcaggaattaccctcagtcagaagcaaccacctcacctcattacagtccctcccttgaaactattcatatccagtgaatttgagagtacaaaggcccagccccttttgcctcaactaaggacatctccgaaagcacatcttagctccaacactccctctgggatctgctggggcctgtgctgcaaatgcatcacagatcaacttctccttctacccagtcctgctctcctcatccccaccagggttgtgcctgaaaacattccccagtaaataacctgcatacaattctccatctcagagactgttgcctggagaacccaacccaatataattatatattttggcttcacactagtggcttagatagttcatcctgtttgtaaataaatcagagccatctccctgacctgggtgcaaaccacaagtagaggcagataatgatgattgctgcatgaggttaaatcctgatgaggctctgcactctcttcacacggagacttttctattttgaaatattgtgccccttgactgaatggctaagttacagaagatccacagatgtcttaggggtatcaaatgaccttcacaaaacaaaaccaagggcctatcaatctaggctaaggaaattagaacatttcctcaatgtaatttttattaacgtatatctgtaagcactgtttatttctgcacctacaatggttcctggattctaaacagtcatggagtttaagtttgtaaaattggtttaaaaacaacttttcagagagcagaagatgaaatttttcactccatgaaatatcccatattctatgagccagcacatgtaaagcacacataacggaacctggtacaaagtaaatgcaagatgaaatacaccatactctgtgagtcagcacatgtaaagcgcatgtaacagaacctggtacaaagtaagtgcaagatgaatgttagctattatatctatgatattaaaatgtgaaaagatgacaccttagaattgaagaaatacggttttttaaatcaatattataaagttacttttagtgttgatttgttgaaatttattatctttatcccagggaatgccttccttggctcttgatccttattttccttgacctgctaacaaacttataaacagtatcattcgattaaatatttcattgttttatttgctattgatcatctattctctttgttttatgggtgttagccttccataatttcacatgctttgttttttatatgtgttgtttttctcattataaacttctaatgggtactagacatgccttacacttctttgcatgaattcgataaataatgacaaactgcttgattttaaaagcatgcaattggaggcaatattagctggcaattctattcaatatatactaagtttttctgtgaatgcctacttgtaatctcacctcctacagaaagtataaaaaccaacaacagaaaaaacaattgagaaatagaacaagtagaaggagtaagttagccaggcacagtggctcacatttgtaatcccagcactttgggaggctaaggtgggaggatcacttgagctcaggaacttgagaccagcctgggcaacatggtgagactccatctttaccaaaaatacaaaacttagcagggcttggtgcagtcccagctacttgggaggctgaggtgggaggatggtttgagcccaataggtggaggctgcagtgaactatgatcatgccattgcactccagcctgggcaacagaaccagaccctgcctcaaaaaagaaaaaaaaaaaaaaagaagtaagttattacagtgcctcctctgaggcattgctgaaatgaatattgtgtttgttctgtattaaaacttctgcattttactgtggttttaaaaatgttattccatttatttttaacttcttcagacagctgtcctggaaaaaataaaacagtggaaggtgagaaagtaagattcaccatagaatacaaagggataaaggagggaggaaagaagagaagctgcaaagaaatgtagatggaagcaccaagctcctttaaaagagagaaaaaccctgactgggcattttagcatgcaattatggtccttaaacttcaccaggacactgtagagtctcagcaaccattctcaaccttcctgcagaaaattgatagcccaaattcacatttttttattttattttatttttgagacgaagtctcactcttgtcgcccaggctggagtgcagtggtacaatcttggctcactgcaacctccgccttctgggttcaagtgattctcctgcctcagcttcccaagtagctgggtttataggtgtgcaccaccatgcccagctaatttttgtatttttggtagagacagggtttcaccatgttggccaggctggtctcaaatttctgtcctcaagtgatctgcccacctcggcctcccaaagtgcttggattataggcatgacccaccgcaccaggcccaaattcacaaaatttaaatgcccctctttcttctccttcacagccaaacttctcaaaataaatgtctctttttttctgatctccacttcctcacctcctccgccactccacagggtgcccctgagcccactgtcctgaaaccacaatgactctgatcagttccacacaggtccatgctgacaacactctgtcttagaccctcattgtttctcccgacctccagtcccaccaagctgcctgcttctctctcggatgtctcaaaatcacctcatactcagcatgtccaaaacaaaaattaataatcttcctcctccagtgttcccccctcctcggtaaatgacaccaccctggacccagtgttgatctaagaacaaatgctggggctcacacttggtatctccgtttccctctcatctctcacatcctgccagttaccgagtcttgtcaatccacgttctttaaatctcttgaatctgtccctaactctgatcttcctggacctcactccaggccagtctcatgtttatctactgattggaaggctgataagcattggtttcttctgatctattctccaccccacaggcagaacaatcttctgaaagacaagcctaatcaagccacaacccctccaatggctttccattgccttcagcctgtttacaaacacctcagcatgcatgatgttcagagtcctcacattccccacccatcattcttcttgcagagaagccacattgctcaactctgggggatgccattcccagcctagtctgtgaatgataactgctggagtagtgcagtgcacaatctgtgtgcctaaacagggcaaccttgcctccgtgtcacactttatacactgtgctgaaagcagctccccgatgcatatttcttctctctctgagcctttgcatattgctgtttcctgtttatacttttacccacctcgatatcattttcttctggttaatcttgtacttcagatctcagtttagatatcactaaccccatgaattttcccttactcacttcacctcccaagtttggattaggagtatccctaaggtttatgtttagtgccctctgcttaacccctattattgtatttatcccttcatcctataattgccggattacttttctgtctccctcttttagggcatggactgtgtttaatccaccttgatgtttctagttcattgtatagtatctggcacatagtagatacagagcaaatacttttgaatgaatgtaactttgagtaaataatttaatctcatcaaaccttagtttactactagtcaaatgaggctaaggatgcctgtcctcaataccgtggagaatcatataataaaatgtatatgaaaatgctttgaaaaatggaaagaaatacgtaaatgagagagaaggagactgaacaattggtatggcattatgataatgagaaagtgacaaggaatgagatgattttctgcagagagaagcaagagagacacatttccaccctatcatgtataagaactaatgcctgtgctgctgaagtgagtgcaaattctgcatcttatttctgaactaggatgagaagccagaatgtttcaaaaggtgggaaatgaggaatgtagtaatcaagctacaacttccgcttattaattggtcacacaaccagtgctgtatattgatttatatgtcatatacataatatatatcaattttgtcacacatattaagatatatatgttattaagatcaagtttctgatatttgttcatttatttaattaattaatttttgtaaaaaagaccaagttgctgaaaatggtgaacgaggggctcagatagtcaaagaataaacacagcccttcttccttgggcatcagttggatttaatgattcggggaattaagtcacttaacttggtaggtaacttgaagcagtattttcatatttacataagcaaacagatatagtatggcatggagtgtaacatttgcatacatcttttaaatcaacctgagaccccacgcattttgtgtttgcaatggacctctccacactatctccctccaatccacccctcaccaaaccttcacactcccaagctctaggaataagtctttattcacttatgctctttgagggcctaggaaaagtttaataagtgttgcttttagaagtttggtgaccttctatgctgctgaaatgaaacaaaaacagaaacctggctcaggaactctcacaaatgtggctggtacacttatatccagggtcaagtttatagttgattattaatttgtgggtctgctttctgttcctagcttacccattaaactgttgaacaattttgtaaatattggtcactggtccccagaagaatcaaaaatttctaaatatagaggaattagtgctaactgtccacaagaaaataattccttttgttttgttttgttttgttgagacagggtctcactctgtcacccaggctggagtgcagtggtgcaatctcagctcactgcaacctccacctcccatattcaagcaattctcctgactcagcctcccaagtagctgagactacactacaggagcccgcatcaagcctggccatcaagactaatttttgtagttttttgtagagatggggtttcaccatgttggccaggctggtcttgaactcttgacctcaagtgatccacctgccttggcatcccaaagtgctgggattacaggcatgagccaccccacctggccagaaaggaatgctaaattcataattccttgctgttaggacacagtggcatcataatctttgtatataacggtcaacacattatatctaaaggaaggagaggggccgggcgcagtggctcacgcctgtaatcccagcactttgggaagctgagttgggcggatcacgaggtcaggagatcgagaccatcctggataacacggtgaaaccccgtctctactaaaaatacaaaaaaatagccgggcgtggtggcagctgcctgtagtcccagctactcaggaggctgaggcaggagaatggcgtgaacccgggagatggagtttgcagtgagccgagatcatgccactgcactccagcctgggcgacagagcgagactccgtctcaaaaaaataaataaataaataaaggaaggagagaagggaactaacatttattgagtctctactatgtgccatccacagtgctaggtgctgtaaattcctcaccatctctccctcaccaccccagacacagttaatcctttgtacaatgtctatacctgatataagcacttctattggactttccactttaaacaacaatgagttgtctgtttcccactctagtgtagactcttcgagggccaggctcattttaaattcacctttttatcccaaacatacaccatacctgatcacataatacatcttcagttaaaatttttattagctaaacaaaagttacctcttccaatgtttaggacattgtgaagaagctagtgcattcttcattctccaaaagtcagctgctcattctaaatcatcttatacagttctgtccattaaggaaatgtagaacatagcattatgtcagttttttgctgttttcaggtcttggaatatttccaagtctctctcctgacccccagccaaaaaaaaaaaaaaaaaaatcatagactcaatctataacatacactgccattgtttgaatgtgtctccttcaaacttcatgttgaaacttaattcccattgtagtggtattaagaggtggggcattttaggaagtgattaagttgtgtgggctgtaccctcatgaatggattggtgccttgtaaaagagctggaaggagctagtttaggtcttttcttgcccttcagccttctgccatgtgaggacatggtatcgccccatctgccatgggagaatgcagcaagaaggcccttaccaaacaacaaatggctgcatcttgcccttggactccccaacttccagaactgtaagaaatcaatttctattgtttacacattaccccatgcaaacagctaaaatgtgtaccatacacactttttgttttctttacaaagcacctttttcaataacataataggtactctgtgaaatacatttttttttttgagaccgaatctctctctgttgcccaggctggagtgcaatggtgcgatctcagctcactgcaacctctgcctcctgggttcaagcaattctcttgtctcagcctcccaagcagctgagactacaggtgcacgtcaccacgcccggctaatttttgtatttttagtagagacagggtttcaccatattgatcaggctggtctcgaactcctgacgttaggtgatccacctgcttcagcctcccaaagtgttgggattacagacgtgagccactgtgctcagccaaaataagtctctaaagtaaattattaagtgtaaatgtccccagtttcagtggctttaaccaatgacagacaacaagactgaaatcacactgcttatagaggattaaatatcctctgattctgaaataccaagtctgaacttctgagtctgtaaccacaagatgatttttcttcctccccaaatttaaagtaatcaaaacatggaaatttcttcctctcatcattgcactttagagtgtatgagaagtgtgtaccatatacatacacatacacacacatgagcatagaagaggaaaaataattagaaagtaggggactagtcaacactctgatttagaaccagctcaactttatgatttcaaaagttttgaacctaatccaactcctctgaaattcaaagttacttgacatttggtatattgtgacttcctgtttttgtaaaagaacattttcaaaaatggttcaatgagctctttggacagtctctaactcctataatgcaagatttggaacatttggtggtaagtaaataaggaacatatgcaatatattttttaagatgtgcatattttccaaaactcagggggaaaaatacttggccaagtctatctgtggtttcattgaatacttgaaaattagttaatgacattcagagacacaaagatacagctgggtttttccatccagtctgtggaacatgtagctgtcaaccagcaatgatagaacccataggaaagcaccctcaatttctgtagaaacaggaaagaattaagatttactgtctggcactttggtggttggatgtagcatttgcaaggaaattaagaacaaagcaaaagagtcccgaaatgtgcttgcatgtttcacatttactctttctctgctgtgtaactgccagtgcatggcccatggtgaaaaataagctggcaaatataaaatccaccaaatagtctctggtaagtctttaggagtactgcaaggtctacaatagatcttactgacatgcaaaaactttaagtgaaaaaactcttagaatgctgcaggtagggatatggagccctaattcctcaagccccaagagcctaaggttacattaacaattaaacccaaatatgttcctggctatgagctccctacctccactccagaccctaagtgatgctagaaagtcataagggtgtctcacaagtgttgaggaataaatcaacactaggaactgctactctccctcagggatttgctgggaacctactgagtctgctgagcccctgcaaccccttgccatcccgttgtcttgccactgttctgctgaagctcagagaaaagatattctcttcataatagtcatcagtgctgccaaacctgtaaaaatctttgatatgctgagtgacattgctaacccttcaggccacatagggccaatgctatgcgctggtccatgcagaaatgtggataccatagtctctctagagaattcatacctactgcatgggtctgaagcgatggagaccaagcagtatactgtcctcgcacttccctctctctcatctctgaatgtaggaacgatcttgcagactttcctgtggtgtactgtgaattgacaccacttaaccagtttcagctcagacacagtcagaaacatcctctatagttattgtcaagaagttcattttaatttgataactttatgtggttaaatagatgtcaaattgccaaagcatggaagagaaaggaaattagaaaaccagaagaaaaatacaaatagatattattcgttctaatgatttttcatactataatacacaatggtcaaagaatcaaaagaaaaacatgcgatccaataggtgttcgataggtatcaaaaaagcatttgataaactcagcattcattgataattaagaaacaacttttaaaggtaaatgtagaaaaatagagaacaacttccttaatttgatatttggtatttaccaaaaattgaaagcaaacctgttacttcatggtgaaaagttagaagcattttctttaaagtcaggaacaaagctaggaggccagctttcactacattttttttttttttttttttgaagcagagtttcactcttgttgcctaagctggagtgtaatggcgccatcttggctcactgcaacctctgcctcctgggttcaagcaattctcctgcctcagcctcccaagtagctgggattacaggcgcatgccaccacacccacctaatttttttttttttttgaatttttagtagaaacagggtttcaccatgttagccaggctggtctcaaactcttgagcttaggtgatgtgccctcctcggcctcccaaagtgctgggattacaggtgtgagccaccatgtctggtctgctatcactacttctactcaacattcctcaaaagaagtaagctagcataaggtctggaaaggaaaaaacaaaagtgtcattaatcatagacaatataatagtttacaaaacaatctaagagaattaacatataagtcattagcactagtaagacagttcagccaggttgctcaatataaaacacatatacaaaaattagtagtgctcccatacaccaggtggcagccttttttttttttaactataaagagccaaagagcaaatattttagattttgcaggccacatgatctctatcttaactattcaactctgccattgtagtgcaaaagcagccactgacaatatgtaaacaaatgggcatggctgtgtttcaataacatcgggagcaggctagattttgcccatagtttgccatagtttgcaactcctgttatacgtcattgatgaaaaactagataacataatttttttgctttttataattttttattgacttatgctaaccactaaggttaggggataggaaacatacttgaaaaagaaaagataccatttactatagcaacccaaactagaaggtacctatgaataaatctaacaaaatttatacaaaacctatctggaggaaattataaaactttactgcaagacatttaaagagatctcaataagtagagatggctgagcatggtggctcatgcccataatcccagcactttgggaagctgaggtgggtgcatcatctgaggtcaggagttcaagaccagcctgaccaacatgaaaaaccccatctctactaaaaatacaaaaattagccaggcatggtggcacacacctctaatttcagctactcgggatgctgatgcaggagaatcgcttgaacctgggaggcagaggcctcagtaaggcgagatcatgccactgcacttgagctgggcatcagagcaagactctgtctcaaaaacaaaaacaaaacaaaaaaacaaaaaacaagtagagaggtataccatcttagtggatgagaaaagtcaaagttttaaacatttcagtattcccaaatcaatctgttaatcaatgtaattctaataaaaataccaatggagtttttcatgaaacttgatagactgatttcaaaatttatggacgctaagaataaccaagacaattatgaagaagaacaaggcagagagacataccataccaggtgccaagatttattataaaagattagcaactaaggcgatacagcaattagcagaatagaatagaggcctcaggaacagacctattgtattagtccgttttcacattgctataaagaaatacacaagacttggtaatttataaaggaaagaggtttagttgactcacagttccacatggctggggagacctcaggaaacttacaatcatggcagaaggcaaagagaaagcaaggaccttcttcacatggcggcaggagagagaagtggaagcagaggaaatgccagatgtttataaaaccattggatctcgtgataactcactcactatcacaggaacagcatgggggaaactgtccccatgatccaatcacctcccatagctccctccctcgacacgtaggcattatggggattacaattcaagatgagatttgggtggggacacagccaaaccatatcacctactcatatatgggaacatgatatttgacaaaggtagcattgcagatcagtgggagtaaagactgactattcaataaatgatgctggaatagttggtttcatatattgtcatatcatatggttccatatcacatcatatggtattaaatgaagttatatccctacctcaaaacacacacaaaaattcatgtcagcttgattaaatatctaagtagaaaatcaaaactttaaaacaggccaggcacagtgactcacgcctgtaatcccagcactttgggaggccaagacggtggatcacctgaggtcaagagattgagacaagtctggccaacatggtgaaaccctgtctctaccagaaatgcaaaaatcagctgggcatggtggtgcacacctgtaatcccagctactcaggaggctgaggcaggagaattgcttgaacctgggaggcagaggttgcagtgagccaagattgcgccactgcactccagcctgggtgagaagagtgagactccatctcaaaaaaaaaaaaaaactttaaaacaaatcagtggacaatataggaaaatatctttaagactgtgagaaaaggaaggatttctaaaacaagacacaagaagcccaaaacacaaagggaaaaaattaaaatatttaactacattaaaactgaaaatttcaatccatcaaaatatcatgaataatgtcaaaagataagctatgttagtaaaaatatttgcaaagcatatcaccaacaaagccttagtatctaaaataaaatacaaaaataagaaaagaaatataatccaataaaacagtttttctaaaagtgtagttgacccattaggagatcctgaaatcaatttcatggattgtggactagcatttaataagataaaacagaatagaatagaaaatatctgaatgcattccacatattaaagataaatgttactttgtggaatttttattttaggtatgtatctatatgtttgcatgcctgtgtacatgctggatcacagtatgaaataaagttcttacggtgggtaacaattttaaacacattgaaatagaaaattaataagatatataggttgtgcaacagtatggatgtgcttaatggcactgaattgtacacttaagaatagcttaaattgtaaattttatgtatattttatcaaaatttaaaaaaatattttaccacaatttaaaaatcatataaacaggtgattaatgaaagagaaaagtttggccaataaactcacaaaaaagacacttgatctcagcaatcatcagagaaatgcaatttaaaatcccatgaaggccaggcgcagtggcttatgcttgcaatccagcacgcactttgggagaccaaggcaggaggatctcttgagaacaggagttcaagaccagcctgggcaaaatggtgaaaccccatctctacaaaaaaaatcaaaaaattagccaggtgtggtgatgcgcacctgtagacccagctactcaggaggctgcagtgggaaaatcacttgagcccaggaggttgaggcttcagtgaaccacgatcatgccactgcattccagtctggtgatagatcaagaccctatctcaaaaataaataaataaaaataagaataatatcccatgagttcctcttcatgccaattagatgagcaataatttaaaagtctgacatgccaaatgctggttgtgaacagaaactgccttgcttgcatttgggattataaacaactataattaggtaacacctactaaagttacccaacaattccactcccacagatgaataaggagaaatattcattgcagcactgtttataataaagaaagaatggacaatctcaatgttcatccacaagagaatggataaatataaacaactactgtacaacagtgaaaatgaatgaatgagtgtcatgtactaacatgaataaatctccaaaacaacattatgccaacaaagctgtaaaagaatacggtgtggtatcttttatatgaagtttgaaatgttcaaaagagtaccccatagtattaaaaatataaatactttcattgaaatgataaatatcaaatcaagcacaattgcctttgggaaaggagggagatggcatcgtggagaatacacacagtcttgaattttatcttctaaaattttacttcttttttctttttttttttttgagatggagtttcactcttgttgcccagactggagtgcaagggcgcagtctcgactcacagcaacctccacctcccaagttcaagcgattctcctgtctcagcctcctgagtagctgggattagaggcatgtgccaccacacccagctaattttgtatttttagtagagacagggtttctccacgttggtcaggctgttctcgaactcccaacctcagatgatccacccaccttggcctcccaaagtgctgggattacattcatgagccaccgtgcccaggcaaattttattcttaagctgggtgacaggtacacagatcatgatttgttattcttcaatctttttctccttgcattgttgtaatgtttcattaagaaaaaaaagaaaatcagtcaacaagagatctctaacagccaattctatgtgaagcactatgctaggcagacacaaaattccaggaaaatagaatgcccaacaatgggcactcaatatatactcagttcactcatgaaattcataactataagatcagacacagtcaattcctcattgtagaaattagaattataggcatgagccagataaagaaatgcacaggattctctgtggccactgagacagcgatgcagaaaaaggagcaggtttgggggatggagatgctgagctcagctgagtatggagtgcatttgggaccgccaaatctgaaaatatgtacatggatttgaacatgagagaagattcagatttgagatgtgtcagcatatggttgctaatgaaagccaggggagtaaaagagatcatgaaaggaacaggaagagatttgaaagagaggagaccctgaggaaagttcacagttaaagagtgtagaacaagctggcagaaagaaactcagccccaaattccagctccttgaaggacaacactaaagtgaatcttaccttaaatgctaccaaagaacaaaagtttttaatgttttattgtagtgaatttcaaatactaaaatagaacagtaaaatgaactccccacttacccattacctggcttcaatgattatcaacccatggctaattttatttcttccataccaccatccatttcattaccccttatattctgaagcaatcctggacatcctatcatttcgtccacacatttcatatattgttccctaaaaggcaatgactctcttttttaaccataaccacaataccagtccaggtgcagtggctcacacttgtaaatccagcactttgggaggccaaggtcggtggatcacttgaggacaggagttcaagaccagcctggctaacatggagaaaccctgtctttactaaaaatacaaaaattaactgggcatggtggcgaatgcctgtaatcccagccacttggtaggctgaggcaggagaatcgcttgaacccgggaggggcaggttgcagtgagctgagatcgtgccactacactccagcctgggcgacagggcgagactccatctcaaaaaaataaaaataaaaaaataaccacaataccatcatcacacttgaaaaaaatcaacagtaattctttagtattaccaaatattcagtagctgttaaaatatccagtcatttcataaaggccataagtttattttacaatgtgtttatttgatcaaagtccacatattgtgattgagtgctatgtctttcaaaactgggtcaggggtgatggctcaaacctataatcccagcagtttgggaggcccaggtgggaggttcgcttgagcccaggagtttaataccagcttggacagcatgatgaaagtccctctctacaaaaaatacagaaattagccaggtgtggtggtgtgtgcctgtagtcccagttaatcgcttgagcctgggacgggaggtcaagggtgcagggaaccataattttgccactgcactccagcctgggctacagagaaaaaccctgaagaaaaaaaaaaaagaaagaaagaaagaaagaaaagaaaactacaagtttcccctactgcatctttttttttttttttgccttgcaattattattattattattttttttttgagatagagtctcgttttgcctcccagactggactgcagtgccacgatctcagctcactgcaacctccgcctcctgggttgaagcgattctcgtgcttcagcctcctgagcagctaggactataggcgcgtgccaccacacctggctaatctttgtatttttagtagagacagagtttcaccacgttggccaggctggtctcaaactcttgacctcagctgatccacccacctcagcctcccaaagtgctgggattacaggtaggagccactgcacccggccttccttgcaattttaaactataattttaaagtttaaaggaaatagataaggacaataaagaggtcacccaagtatttcctggagagccattttggtggaagacgctgaggaaaggtagctaagctcttttttttttttttttttttttttttaagatggagttttgctcttgttgcggatggagcgcaatggcgccatctcggctcactgcaacctccgcctcccatattcaagcgtttctcctgtctcagcctcctgagtagctgagattacaggcgtgcgccaccacaccagctaatcttgtatatttagtagagacagggtttctccatgttggtcaggctggtctcgaaatcccaacctcacccagccggctctttttatttttattttttaagagacagagtcaccctgtcgcccaggctggaaagtggaatgcagtggcacaatcatagctcactgcagtatggatctaactgagctcaaacgataaaaggatgaaagcctcagcctcccaagtagctacgactgcaggctttgcttgggataagctcatttttgaactgtaattggaactcaggtttgttcagactgtggttgcacagaacaccatcttgcattaaatcatagttttaattgcattagactatcatgaaaatgctctgtgataacttctgtcactgtaagtaaagttgaaataaggaccaacataaagctcatctttaaagaacgaaagggattggcttttgagctgccccttttatactgacatatttcctgaggacttatgtttctaaatgaagcaataataaattgatttaactgtaatgtaggcagttgccctcagtaaaaacaattaacctaacaataaacttagagacatttcaaattacttgctaaaactatggacagaagtctagccccatgtagtagttcttaacacacgtttaatattcttggctttttaaggcaataattaaattttactttacccattttgtacatttttttttaagatgttaaacatatgttcatgttagcaagtttccacgaaaccttgcaaatgttaccacacaactaccatgggtttcctcacaggttctgaattccagttttttgctcatggagtcaatgtctttaaacttcttgttgtttaaaattggatttctatctcaggcaccattttcgtattaaactatgagctttttcttcttgtggctatgagggatttccatgttgctgcacaatgaacccaccttaccttctcatctttggcagctgctttgggtttataatagaatctaaactgagatgatagagtagcgtgctatgatttgaatgtgtcctttctaaaatgcaggtgttaggggcgagcacagtggctcacacctgtaatcccagcactttgggaggccaaaacgggtggatcaactgaggtcaggcgttcaagaccagcctggccaacatggtgaaaccctgtctgtactaaaaaatacaaacgttagttgggcgtggtggtgcacgcctgtaatcccagcttctagggaggctgaggcaggagaattgcttgaacccaggaggcggagagtacagtgagccaagatcacgccactacactccagcctgggcgacagagcaggactccacctcaaaaaaaaaaaaaaaaaaaaagagagataaataaataaaatgcaagtgttgaaacttaatggctaatgtaatggttttaagaggtgattggtcatgagggctcctccccttgtgaatggaatgaaggccctcataaaagaggcttcattcagcctttggtttgcttgctggcctgcccctcccttccgccatgtgaggacacagtgttcctcccctacaggggatgcagcaacaagatgccatcttggaagcagagagcatccctcaccagataactgaacctgccaacaccttgatcttaaatttcccagcctccagaactgtgagaaatacattcctgttcttcataaatggcccagtctctggtattctgttatagcagcacaaacagactaagacagctgatcagtcctcatggagcacccaggcagcttggacagtgatgagtccctccctcaagtgactaatgggtaggagacaccaaccagagactggagctgaagggtatgagaggccttgtcagcagcatatatgtgtgagacacctggagaaatacctgaggtggggaagaggatagtgccagggtactatgatgatgagatgggggtaatatgctatcaatacccaaagatttttgagggctttatctctctctctctctttttttttttttttttttttttgacagggtctcactctgtcgcccaggctggagtgcagtggtgcaatctcggcttactgcaacctccgccttccaggtgcaagcgattctcctgcctcagcctctggagtagctgagattacaaacacaggccaccatgcctggctaattttttgtttgtttgtttgtttgttgttgttgttgttgttgtatttttagtagagacggggcttcaccatgttgcccaggctggtctcgaactcctgacctcaggtgatctgcccaccttagcctcccaaagtactgggattacaggcatgagccaccgtgtccagccaaggcctatatctatttttttttttttttttgagacagtgtctcgctttgttgcccaggctggagtgcagtagcactatctcggctcactgcaacctctgcctcctgggttgaagtgactctcctgcctcagcctcccaagtagctgggactacaggtgtgtgccaccatgcccagctaatttttatgtatttttagtagagacagggtttcaccatgttggccagactggtctcgaactcccgacctcaagtgatccacccgcctcaacctcccaaagtgctgggattacaggcgtgagccaccatgccctgccaagtgctctatggatcaagacttccttgggtgcaagtccaagtgacaagcatcaaactcaaactggcctaagcaaaaaaaggcaaattattgagtcacttcatttaaaaagtcaaggggttcaaacaatgtcaccaggtcttgtttttctccctctgttttctgcctggtattttctggtttttacttatttttagcccaacttcctacaggtcccagaactccagccttgcatcagcctgattctgtcaatccctgctaaaagggatacctttatttctacttagtttaattaaataaaggtcccagggtggaaactcattggctgcagttgtgccacttgctagtgcatgagccagtgagaatggaagagcagccgggcctggaacacgaaggatgggatccctctgttcacacaacatgaactgagaggaaagcagagcattcctcctcggagatcaaaacactgttaccacacaaagagcgaatcagtgatgagcagaaaaagaaacatatgtgcgtgaacagcggtgtgcaaaatcgcatgttttttaaactcctgacaaatggtcaagcagaatatagacaagagtggaagactcgagctctagccagaagcagatggggctgatttctagagtaagaaggagaaggaatgtgtgggagagcagagagcagaaatggtgagatctggaggtattaacaaggccactctgacagcctatcaactagaaatgagttgcaggacagagagcagagagggacaaaggcagatttggagagcatataagacagtgtgcttttggttgcacgtgacaggacacacaaatgataacatttcattattccatttggcagttctagggttggttgatgcagtgccatgtgacatggggtctctgggatggaagagacgcccggctttcaccccatagtttcgagatggttgccacagctctgggcaatacattctcacacatcaatgttcaaaggcaggaagaaagtgagggggtggcctttcttcctgcttttttctctcttatcagggaaaaaaatcatttccagatactcaacaggtttccttttatatctcactgacctgtttgagtcacatgtccaggttctcattgcaagagaggctaaaacataaaatccagcattcagcccctttggtggaaagaaggctctgccaacaaggagaccagctataccaaaatgggagtcagcgtccagggatcaactggggacaagctgctgaggacaagtggcaggattccatctgagaagaggtgctgacagtggctctctaccttcctctgtcttccatggtcctcacactctgaattgttcatgagagcaataggctttgttgtcctaaattatcatttacagtcacacgtcgcttaatgactgggatacattcttagaaacatgttgttaggtgattctgtcattgtgccaacatcacagaggatacttgcacaaacctagatggtacagcctactgcacacctaggctatatggtgtagcctattgctcctagactacaaacctgtacagcatgttactgtaggcaattgtaacacagtaggcaattgtaacacaatggtatttgtgtatctaaatatatctaaacatagaaaaggtgtagtaaaaatatggcattataatctttttttttttttcttgagatggaatcttgctctgtcaccaggctggagtgcaatggagcgatctctgctcactgcaacctccacctccagggttcaagtgattctcctgcctcagcctcccaagtacctgggactacaggcatgcgccaccacgcccggctaatttttgtatttttactagagacaggttttcaccatgttggccaggatggtctcgatctcttgacctcgtgatccgcccaccttggcctccctaagtgctggaattacaggcatgagccaccacacccggctggcattataatcttctgagaccaccatcatctatgcactccattgttgactgaaatgtcattatgcagcacacggctgcatttgcttttaaatgatatttacactttcacaaactataaaatatctaggcataggaatatatttatgaaaaatttgcattgcataatttttaaatgcaaatccaagttgaaaggatgcagagatttacataaatgcagaaacattatatttttagatttaaaaatgagtatagtgaggatgtcaatttatcactgctatggtttcgatgtttgtgagccctccaaaatccatgttgaaacataatccctagtgcaatagtactaaaaggtggtgcctttggaaggtgactagaccatgagggctctgccccataggcgggactatcacccttataaaagagcctgaggaagagtttgtccctttgtccttctgtattttgtcatgtgagaacacagtgttcatcctcccaaggttggggcaacaaggcacagtcttggaaggagaaagcaggcctcattaaacacagaacttgccaatgccttcatctgggacttcccaacctccagaattgtgagaaataaatttcttttttttttttttttttgagacagagtctcgctcttgtcgcccaagctggagtgcaatggcgtgatctcgtctcactgcaacctccacctcccagattcaagcaattatcctgcctcagcctcccgagtagctaagattatgggtgcctgccaccacgcctggctaatttttgtatttttagtagagacggggtttcaccatgttggcaaggctggtctcgaactctcaacctcaggtaatccacctgcctcggcctcccaaagtgctgggattacaggcgtgagccaccatacccgactgagaaataagtttctaatgtttataaattacccagtctgtggtattttgttatagcagcacaaacaaagacaatcagaaataaatttataagtttaacatactactgttttattaatcttatggaattttttgagggataacgacaggattcaaaaatgtatctagaaaaattattgaaaatgtgggccaggtgcggtggctcacgcctataatcccaacactttgggaggctaaggcaggcggatcacctgaggtctggagttcgagaccagcctggccaacatagtaaaaccccatctctactaaaaatagaaaaattagttgggtgtggtggcacttgcctgtagtaccagctactcaggaggctgaggcaagagaattgcttgaacctgcgtggtggaggttgcagtgagccgagaccgtgccattgaactccagcctgggtgacagagcgatactccatctcaaaaaaagaaagaaagagagagagaaggaaggaaggaaggaaaagagagagagagaaagaaaggaaagaaagaaagagagagagagagaaagaaagaaagaaagaaagaaagaaagaaagaaagaaagaaagaaagaaagaaagaaagaaagaaaaaagaaagaaaatgccaaagataattcattaaataatttggccatggtaggtgcccatagtactggccacttaagacgctgaggcaggaggctctcttgagcccagtagtttgaggccagccagggaacatagagagaccccccatctccaaaaaaaaaaagttttaaaaataaaattttttaaatttgagggtgttcctactggaaattgtttccttttgtggtgattagtcttttctgaagttcagcaattccttaagttttactaaaactttttcttctgataaattcaagtaaaattaaactcagtatttttagtggaaaaagatacagtatcatctcattcgtagaaaacagcttgatctctcaatttattgagcaagcctgtggatcgtgctgtgtgccactgtgttccagatgtgaggataagcaggcaactggacaaaagtaaatctctgccctgtccctccagccatctacccaactatcttccgtctgcttctgtgtactaatagatgtgttcgaatggtaggattgagtttgattcttcttttctctgttatatttccctgaactacttcacagtaacaataactgtcaggtatgtcctccagaagcagatgccaagatgaagatgagggtggcgaaactggggaggtgtggtcaaagggtatgaaatttcagttaggaggaataagttcaagagatctattcatggccgggcgcggtggctcacgcctgtaatcccagcactttgcggggccgaggtgggcggattacgaaatcaggagattgagaccatcctggctcgaccacccgggcagagtggcaggcacctgtagtcccagctacttgggaggctgaggcaggagaatggtgtgaacccgggaggaggagcttgcagtgagccaagatcgtgtcactgcactctagcctgggtgacagagcaagattccgtctcaaaaaaaaaaaaaaaaaaaaaaagagatctattcattctagttaataacaatatactgtctacttgaaaattgttaagacagcagattttaagtgttctaaccacaacaaaataagtacgtgagataatgtctatgttaattagcttgatttagcctcctatttttttttttcttttgagacagaatctcactctgtcactcagtgtgcaatgacacaatctcggctcaccgtaacctgtgcctctcaggctcaagccatcctcccacctcagtctcctgagtagttaggaccacagacgtgtgccaccatccctgcctaaatttttttttcctgtttctccatgttgcccaggctagtcttgaactcctggactcaagtgatcctcccaccttggcctcccaaagtgctgggattacaggcgtgagccaccacacccagtcaggttgtactattttgtacacacacacacacacacacacaattgtgaatttttttaataagtaaatttacaaaatttttaagatgaagataaaggtgtcggaggttggctgagggtagttcctgtgaaaagtgaagaggagagagagcaggatgaggcaggaaaaagccttcagattgtaatatctgtctgacaactgtgaaagaagagtgggagggaaggaggcttgggtaggaagagttccagactgcagtgcagctctgaggacatttcacttcatcaaacaggggctccacacacagatttctcacagaggagtcctgtgttaggcaaagatggccaggacctagtacccttgccacgctcagttgttgagcaggagttgcctgggaagagagtggtctccattcccatatgccatggcagaccctgaaggttttgcatctacaggcagtcagtgcattgcactcctcacagctgaaatgtgagctccttctcaaagtgagatctgagcagggcctgcatgtctgccacagcagccacgtgagatttccatttttaaaagccagttcctggcagagcacagtggctcacgccggtaatcctagcactttgggaggccaaggtgggtggatcacttgaggtcaggagtttgagaccagcctggccaacatggtaaaaccccgtctgtactaaaaatacaaaaattagctaggtgtgatgccacatgcctggcgttccagttactcaggaggctgaggcaggagaatcacttgagcccaggaggtggaggttgcagtgagccaaaagcataccactgcactccagcctgggtgaagggagtgaaaccctgcctcaaaaaaaaaaaaaagccagtttctttaaaaaaatgttgcttgtaatcaacatatagaggcaaaagagtggaaattaggtctgtgttattttctgctaaattaaaggcaagcatccacactgaggaaaacatttgaaataaacatgataggcaaattaacaagtttttagctagggaggattttatatatattggttttgttaaaaaaaaaatggaaggcccaatataggtaaaagatattattagaaaattctccaaaaagaaaatacaaaacaagtagaattggaacagcctcaacctcatcagtaattaaaaataagtaatgttaaataatttttttctgaagaaattaataaaggtttaaaaaatgtttgatacttagtacttgtaagggtatgatgaaataagttattcttatacatttctggagttggtgtaaattggcgataattttggacctattatttttccgtagaagaatatattctaggcacggtggctccagtctgtaaatcccagcactttgggaggccaaaggagggtcacttgagcccaggggttcccgatcagcttgggcaacatggtgagactccatctctacaaaaaataaatttaaaaaattagccaggcgcggtggtgcatacctgtagtcccaactactcaggaggctgaggtcagaggatcgcttgagcccaggaggttgaggcttcagcgagccatcatcacaccactgtactccagcctgggtaacaaaaagtagaaaaaagcttgggacacaaagatgttattttagtcaggattcttgattatgagaaacccaactcaagtggcttaagctaaaaagggtaaattacatgtcacataagcaaaccatggaaagtcgggtttagaacaggccttgggttagactggatgcagaaactccacagaattaactcatttcctctctctctctctcacacacacaaatgcacacacgctcacacacacattaatttcctcactctctgaggtgtattgaccttgttctctcaggaccagaagaaaacaaaaacaaaagcaatggcaccttaactattaggtactgaaagattgtcattccagacaataatccaagtgtttaaaaggagctcatggccgggcacaatggctcatgtctgtaatcccagcactttgggaggctgaggtggaaggatcacttgagctcaggagtttgagaccagcctgggcaacatggtgaaatcccatctctacaaaaaattcaaaaaattagccaggcatggtggtgcatgcctgtagtcccaactacttgggaggctgaggtgggaggatcacctgagcccaggggttgagggttcagtgagccatcatcacaccactgcacatcagcctgggtgacagagtgagatcctgtctcaaaaaaaaaaaagagcttgcatatagtctctcatatggtggagaataaggcaaagaaggcagccattaactgtgaggccgtgcgcttatagcttgtgatccaaagggaatgagactgctctactcagcctgagtcacacgcacctcactggcttgtcatcatggccagcttttccttgtttggtctgggttaaatctgtcccctcctttcagtaaccgctgcctcccagtctgatttcagatcctcacactgtgtactctcacctggactgtctatactggctcctaacaggtctcacaatttccagaacaacccccacccccagccccacatgctatacatagccccattcatccatcctgcacactgagaccagggacattcttttgcatcaagtttttgccgactccccattgctttcaggatgaggccagtattctttgtctcagcctacatagcagcacagtctcattcagattctcctcccactatgctctccttcacatctacagtcccagcagacacgctgccatctcccaagccgtctgcgtttttgcacacatcatgttttacatgccactgctggggcagccagttctgggcagcctgcaaccggctctgagcaaatacaacccgaggccaccttgtccctgttccacaccaggggcctccagcctcgtgctctgtggcttctctgacacccagagggtgggatgtccgtgagaacctgctccactcttaggcaggcacaagtcaaaagcccaggactattaaagcctactagaccacccttgaccgatagaagattagagctgatggataaatgcattccccttttgtcccctgagaggatagttttgagacgtatttcataaagctcctcagaagtcccccaggactgaacaccagtcacccataccagtgctggtctcagtggcgaagtccatgtattagcagcttctttccttctctgcctgacttcccctgggattgcattcccaaatcatctacctgttctcaaatctttgcctcaggatctggtctggggagaacccaggctaagaaactgagatatattcaagccaaaggctcccccaaaggtcataaactaaccacatcgttaaagaagatcctaaggctgaagaaagaagaaagaccattcagtgaggaagcaactgccttactccaatatttatctctcgctcagatataactggagacccaagtagccaaatctcagagcaggtttgcagtcaaagaaacaggccagcaacccaactcaaacctattaaaatcattgctatcatctttcttgaaaagcatcaaggccaggaaagtgtatttttaactcaaaacaaaacaatattataaaaataccctctttaacctccaccacttcaaatatcctccatatggaaaagaacttgctcccaaatccacattttctctccttgaccttcagctctcaaatataaaattctttagaaagaaacaaacccctcatagctctagactttcctctcctttcatttccccctttcttctctcttgtgagtaaatcttggccttttttcatgaaaatactccaactcatctcttcttctatgttctatctattgtctaccattgttccaaatctgtatcaggaaagcccagaaagcaacctagcaaaggcagaatccacctcagctcttaggagaaaaggaaaagtgggagttgctagactcagaattctcttaggggcggaggggaagtgcagtggctcacgcctgtaatcccagcattttgggaggctgaaacaggaggatcacttgagcccaggagttcgagactaggcaacatagtgagactcccatctctatttaaaaaaattaaaaattaaccaggcatggtggcacacacctgtggtcccagctactcgggaggctgaagtggaggaggactgcctgagtccagttgaggctgcagtaagccatgattgcaccactgcacactccagcctaggcgacagagcgagactctgtctcaaaagagagagagagagagagagagagagagagagaaaattctctttagagggtaaaagagagctatgaacattcaactttaatccttttgttctcagtcacccaatacactcagtagcaccctaggaagcactgggtcagtcaagcacagaggcaagtgtatctaaggtttcctcatttctctacaaggaaaaggataaaagatgagtgatgtgaactgactttaaagactgaagttaacccagcaattcccatagtccatgtgcaatataactacctatacttttggagtatgtgttatacaatattttttatatttgttaaatcttttaacataactttgtgcctgaagaactgactggtggttcagatattcccaagaatgctgggagtggcattatgttatggagcaatattccatgacactaaatggtgggtggggggaaattattagaggtttacctggatcacagtgctgccagcactggaaatcaaattattatcacatgtggccgggcacaatggctcatgcctataatcccaacagtttgggaggttgaggtgggcatatcacttgaggtcaggagttcgagaccagcctgcccaacatagtgaaaccccgtctctactaaaaatacaaaaattagccgggcatggtgacacatacctgtagtcacagctactcaggaggctgaggcaggagaattgcttgaacctgggaggcagaggttgcagtgagccaagattgtgcagtggcctagatgacagagcgagacaccatctttaaaaaaaaaatcataatcacgttatttggtgagactgaattcagggccacgggagctgaaggcataatggagctgtgaccacctgacacttccaactcctcagcaggcttcacctgccacttgagttgggtgggggtgttgccaggccagggtgcatgctgtgcaggagagagcttccagggtctgtttctcctacggtttgaatgtggtttgttgtcctcaccaaagctgatgctgaaattggacccctactgtggcagtgttggcaggcgaggcctggtggaagtgtttgggtcatggggatggatccttcatagacagcttggtgctgttctcatggtagtaagttctcactctctggagagtagattagttattgcagtaatgaattagttcccttgagagcaagggttacaatgcaagtttcctccttctgtttggctctctgcacatgtccacttcccctttgaccttctctgccacgttgtgcagcacaaaagcctttgccagaagccagggccatgctcttgagcttcccagcctacctaactatgtgctaaataaaactcttaaaaaaaaaattacccagtctcaggtattcttttatggcaacacaaaatggactaagacagtctttctctcccttttccaagactgagcaaatctccttctacctggctctttttttggctagattaatatcgttggtcaaggtaggccctatcatgggatggaagtagacagtagagaaatggcttgggcatctgaaatggactgggtgtttgtggttccccaaaattcacctgttgaaatcctaacaaccaatttgagtgtattaggaggtgtggcctctggtaggagaataagccatgaggatagagccctggtgaatgagattagtgcccttgtaaaagataccctagacaactctctcaccctctttctaccaggtgaggagacaaccagaagtctgcagtctgcaacccagaagagaagaccttcatccgaacccaaccatactggcaatctgatcttagacttccagcatccaaaactgtgagaaataaatttatattgtttatagccacccagtttagggtactttgttaccaaagtccaaactgactaagacaacatctctttcacaaagggcctctgttatagcaggctacccagagagccaagagatacaataatgcaattgaagaatgacatgcatcgtacacatttatgcttgaactccaataacagtccacattgcctgggtgcactatgaaagactaatttcacaaatcccataattatcttgtaacacaattatattgtagtatgtgttatatattagtgttaattacctcaatgtaaacatttagaatagcacaattttaaaagtctgttttgtgggccaggcgcagtggctcacgcctgtaatcccagcactttggaaggccgaggtgggcagatcacaaggtcaggagatcaagaccatcctggttaacacagtgaaaccccatctgtacaaaaaacacagaaagttatctgggcatggtggcgggcacctgtagtcccagctactcgggaggctgagggaggagaatggcgtgaaaccgggaggcggagcttgcagtgagctgagattgtgccactgggcgacagagtaagattccatctcaaaaaaaaaaaaaaaaaaagtctgttttgcatgtcttcttttccttcaataagtaggaataactgaggcctctcaaattctgagcagtcctggatcaagtagctcttgtttgaacattatctctctaaaaatgggaatttgcaggtctttaccctgttcagttatgtgttagctaattagcaagtgagagaaaattaaacaactgttagctgagtgcctactctttgtaaggcactcggcaaaggtgaaaaaataatggacatagttcctgccctcaacgagtttacattccagagtaggagatggaaactaatcattgaatcacataactaatctaaaattacaatcatagaggtgccaagacaaaaaaataaaataaaactacaatcattatgagtcataataggggaatttgacctttcttactgggaatcaggaagggtattcatgaagttaaacagatatctgagaggaaaacaagtagaatagaagggagtggcagaggccgggagcagtggctcatgcctgtaatcccagcactttgggaggccaaggcaggtggatcacttgagatcaggaggtcaagaccagccaacatggtgaaaccccacctctactaaaaaaatacaaaatttagccgagcatgttgactcatgcctgtaatcctagctacttgagagtctgaggcaggagaatcacttgaaccctggaggctgaggttgcagtgagccgagattgtgccactgcactgcagcctgggcaagagagtgagacaccgagactccatctcaagaaaaaaaaaaagaaaggaaaagaaagtggcagagacacaaagggggtcacaggcagagggaagagcatgtccaaaatccctgtagtgtgagggagctgcacagatttgagacattgaaagatgtctgagcctctggagcacagaaagccagagagaacaggatcgagatgagtccagttgggaaatatgactttgagtctccaggttttgagtgctggtggttgagggaatggggaatcaccttgctgttgcccacacacaccaccttcaaatcctacccagagtaccactgcccccaatatccacatctgaaatcatctttcagagcctaacttgagcctgggcttgccagaaataactctattaatcacttactgcccttgatgcaggactttgtgcttcagattttgaacagcaatgaaacagagagagaacaaatccagaatggggtgaagtgttgccttaaggaagacaattcaagcaataatattaaattactttagaaaagtggatggaaaataaggaaatacacccacacagcaaaacttttaaagtttttccagatagagggactttcattcattcacagcaacagctttgagttattaggagatttttttttcacatgcaaatattgcaatgtatgtgaagggatatggtgtaaagatgggttacaaagaagctaagttagagggaatcagcagagccaaactttggctcttttcaaagactaaaataaaagagccaaaaccggcaaattcataaagaaataaaaaaagaaagcacaaataaacaatattagcagtaaaaagtgaacattatagatacaatgaagactttcttaaagaaagaaaactaagaacaactttttggcaacaaatctgaaaacaaattccaatagactaaatgtttgtgttccccccaatacacacacaaatttatagtttaaaacctaatccccagccgggcgccttggctcatgcctataatcccagcactttgggaggccgagacgggcagatcacctgaggtcaggagttagagaccagcctggccaacatgatgaaaccctgtctctactaaaaatacgaaaaattacgccaggcacagttggcaggcgcctgtaatccctgctacttgggaggctgaagcaggagaatcgcttgaaccggggaggcggaggttgcagtgagccgagatcgcgccattgcactccagcctgaacaacaagagcgaaactccgtttccaaaaaaaaaaaacctaatccccaatgcaatggtatttggaagtggggcatttgggaggtgtttaggtcatgagggtagaacactcacaaatgcgattagtgggtttataaaagagacctcagagagttccctcacccattcatcatgtgaggacacagtagaaagatggtcatctgtgaaccaagaagcaagctctcgccacacacagaatctgccagcacctcagtcttggacttcccagctttcagaactgtgagaaataaatttctgttgtttgtaagtcacccagtctatggtattctgttgtagcagcacaaaaggactaagacacagattaagtggataattgactagaaaaaaatataactcatcaaagcaattcaataagaaagtaagtaggttagagtatacataatggatttaggcagagaaaatagacttaacctcaaataattaagtgccagttcaaggcaagtgacagaaaaggcattctggaattccttttgcagcaagccaagtgcagtaaaaatgggccttttccccagtggttgtaccaattgcctacccataatgttcaaagtgaagacttaactgtcattatcaatgactgagccagatttttttctcacattgatgtcttgttgacctgcaagttttcctgaaacttctgccaataatattacctttatgggcctctactttaagcattctgtgcactgtaactggcctaaagcattaggccagcagttctgaacatttgggtctgcaggatacctttgaatactagtggtacacttgaaagaaagtcttcagacaatactaaacaaatcagcaataattacgatacaatcctactataatataacaacatagctctgactgtaaaagcagccacacttgcgattgtcactctctagcagcatgttactatttaggcagatcctattactgcctaactgtaccctagtatacacttttaaggtcataaccttacatctcacatccaaccaacagaagacctttctaggtaccagcttaaacttttccttataccttttatgtgttacccacagcaagttctatgctactgtactatgctattgtgtcatataatcccctc

SEQ ID NO: 309 - DNA, 2534254 bp, Homo sapiens (residues 1-1,267,127 of 2,534,254)
  misc_feature (113081)..(163080): n is a, c, g, or t
  misc_feature (349820)..(399819): n is a, c, g, or t
  misc_feature (574875)..(624874): n is a, c, g, or t
  misc_feature (826584)..(876583): n is a, c, g, or t
  misc_feature (1003061)..(1053060): n is a, c, g, or t
  misc_feature (1247676)..(1297675): n is a, c, g, or t
  misc_feature (1376374)..(1426373): n is a, c, g, or t
  misc_feature (1553637)..(1603636): n is a, c, g, or t
  misc_feature (1774306)..(1824305): n is a, c, g, or t
  misc_feature (1862617)..(1962616): n is a, c, g, or t
tggagtgcacctgtcttatgacgctgttaacactagaaaatattttctaaatgtgtaaattgaaggctcacaaattagttaagtgagagaaaagataacggattggaagagaattaccatattcattaggtgtgtttttaaaattttaaagtaaaatagagacatgatttttttcacactttcgaatgcatctataaaaaatagacttgagggctgggcgcagtggctcacgcctgtaattccagcactttgggaggccgaggagggcggatcacgaggtcaggagttggagaccagcctgacgaacatggtgaaaacccgtctctactaaaaatacaaaaactaggcaagcgtggtggcgcgcctgtaatcccaactactcaggaggctgaggcaggagaatcgcttgaacccgggaagcggtggttgcagtgagccgagatcgcaccattgcactccagcctgggcgacagagtgagactccgtctcaaaaaaaaaaaaaaaaaagttactcattaatagcatagaccaattggcctctattgaaatttctccattattttcacaatgtcccaggctgtgaaatcaggatttaataaagaaccagaatgccatatctgtgtcacctgggtagggaccagtcctgatccattaagtccgggtctctgggtaactggactcaactgctggactaaacagaatgtccggcgtgggttcctaaccgggcaccacagaacctcatgagaaatgtagtgtcactttccaacgatgttaccatcaaggactttgggaaccagcttttctctctgcgcatgcgccgcccggcccactccgccattttcatccggaagtgcgtcacccagaggcggtcttgtagcggggccggcttggggcttggttctatgtccctgcgggtcggtgcgagggcgaagaggaacccgtgggcctcgggggatcccggggggccggaccagtgtcccctagttgtgggagcagacgcgtgggcgcatcgcgggcgggcagggcctgaagtgcaggtgcgggcagcggaccctggcgggggctgggaggacaggcgtggggtcccggcagtgaagcgggttctagaggcgcaggagcgggtaggcgaggccggtggccctgggcccggagtctgcaggccgcgctcctgtcctgccgctgagggacccggttaccaacccgcatgacgctcagtttgcccatctctcccagtgctaacacacagttctcgggagacgttccccattcccagaggagtagtgcgaaatgcgtgcgcctctagtcttaaacttggcgtttgtattagttgggtttcctggtgtctctttagcaagtgaagtttctggttccctccttcactgtgtgacctgcctagtcctcctgggttgcatttacagaagtttatacgagacctagtttccagggaagaactcactgattccgcgagggagatggcataatggatgatggtcttcagccttaagggtacttcagtcttaactgtgtgttacaaagtttgaaagagagggttccctatgaataagaagcgcacttgaaagaacagctgtctggtctaacctctcactggtgcttcagaggaggaaaaaaggtcacaggtgaggatcccagttttcctcgctcaggaaatattaattctactccctagaatgcacaagatttgcaaagactaggtgatagtagaaggtttggacgaactttcagaaggttgaggtgtattccgctgagaagaacaggcaaggacctaggaaatattccttatttgaaggggtctgaaagtgtggtccggggtacaggagtgacctgtcatacttgagaagattaaaatactctccaaacacagtcccattccttcaaccttagctcgtttttcccagcgtctgagatatattaaacctagtccatccccaaatttagcattagattgcgaagttctattgattgtatttgatttgtaatttaagattttctccccctacgtaattttgttaaaaacacagaagtgaattctgttcacttaggtgtaacagttaatacttgctgtttaaggaactaattaaaccttactggcttataaaaaacaaacaccattttatttgtttgaagttctgtggatctgcattttggtgtggtgggttcagctgggtagttgatatatttgtgttgcctggatcacaaaaagtccttagtcacctggtgcctttactgagcctggttggtttaagatagtttccttcacaatctggtggtttgtggtgactcttggctaggccctgtgtctccaacagggtagctccagacctcttcacaatttgactgtgtccaaaatggcaagaaccaatggatatttgcatcacattttccattgtccattcactggacaagtcagatggaaaagcccaatttattatcagagcataatatgagggcttgcatagaaggaaagctgttattgggaaacatgagtacaatggtgtactgtaggaaatacatattatgtacattttaaaaaatgtaattgtaggccaaaattgctggtttgcaagatgcactttccatgatgttcagatatagaaaagcaagatgtactgtcatgggaacactcatatgaagttatttgtggaatctacatataaataggaaaatagttaatacagcctagtatatttctataacatttattttagtgaacttataatgtttctttgcattaaattattagattatatctttagatcatattgttactaaattaataggtaatacatatttttattcaaaaataaattgtgcatctaatgtctaccaattaatgtacttgtagatgtatcttatcttaacttgagtctttgatgcccctaatgaggcgtgaaggactcttctcccatggggaagtttttctttttcaggagggaggagagctttcccaggtaatgtgtctagagtgttgggcagaagaatctgggactacaccacaccagttctctgcttaatccacgtcatttgccttctatcccagctatgtttccagtgtcctctgggtgtttccaagagcaacaggaaacgaataaatctctggtgagttgtttatttgttcttcactttgttttacattgtattttctgagtttttgggtgtctgtgaattaaaaaggaaaagtagaaataagtaaaactcaggttgaaggaaatatacataaataagataaagctgacctgtagatataggcaggttataagagcttagagttgtctaagttgggtgcaaattttcctctgatctttctgatgccgagacaaaaaaggcagtcatatttgttacgtgattggagtggaacccgagaagagaacatgctgtgttcttgtgggacaggaaagcttgcgtgcaccaagtccgaaccaccaccttcattggtgacatagattatgtgctggaacatatttcacaccggcctggcagtaaccacttgtagtgttgtacagtggaaacggtcatcttccgctaaagcacagtgtgttttgcagtggaaatggtcatctgccgctaaagcacagcttccatcgtaagatatgctccttgctcaaagagtgtggtcccaaacagcttttgggaggtcctccttgattcatggatgaaacccagaacatcttgaggactgagttaaccataggtccttaaataactctccacactttttcttactttgtctctacatgcagggtgtgcagcagcctgttcaaagtcatattttctgggaaatatttccagtgtttatttgcactttagcccactctgtgtagtcttaacttatttcttctaaactcaccattaacctaaataatagtcaaatttagggggactgtatttgccttactcgagtcttctaccatagttgaaactgtcgtacctgagtgagagagaaacgccacactttgagacgaattcaggagtcctttattagccggtgactgagagacggctaacgcacgaaattctctcggccccgaagaagggactagattttcttttataatttggtttagagaggggaggggggattctagctgcagcaactttacagaagaaataaacagacaaaaaagttaaaaagacagatggttacaggaaaacaaactgttccaggtgcaggggctttaaattcaccaaaaagtgataggtgagggggctctgggcattatctgccggacaaatgtgggggctttatgatactatctctgagtaatttgctgggaactgcggacatctcttgtctcagcactttatcagttaattgcactctttgatatgttgaaaatcagcttgcacaagttaaagtccttgaggaaaaggggtgggtaagaagcccttgatgttttgtaaatgaaggagccaaatggaatttgtctggttttctcagctaagggagagtctattcatattaaaaacaaggttagctatctaaggaacatctattcatgttaatacaacgttgggtattacaaaacatctgttcatgatctggaaattcttctgtgttagttctgttaaaagaaaaactttaaaggagtttaattgagcaataaacgattcacaaatcggacagtccccagaatcacagcagattcacagagactccagcgcagtcatgtggtggaagaagatttatagacaaaagggaaatggcataccgaaatcggaagtgaggtacagaaacaactcagcgtttgccttgtttgaacacagtttgaacatttggcagtgcctgagttgttgaagtttggccattgggattggccaagatgtagctgttgttccaggtgcatactctcaagttattttttcattcttgtatacctattaaggtaggttgcagttcatccacaagtactcatatatagaattatggagtccttctcaggccatacttagttcactttaacaatgccttccctttggttattttctcaattttgagagattggccaaaacttcagtcactggtgtcactattaccattgcaaatgtacttacttggtttagaaacccactgggaaatagaccagtgagatttgaaaaggtggaacaaggacttgagtagaaggtatcttcttatgctggaacatcctgtttataggagaaaaacaaaacctggtttgttctaggatttatatgtttccttaaagtcttagtttgattatgttacatttagcatgagtgactccattttggtttggtttggtctgttgggacctattgcatgagcttagttcaaaacaatggcctcccatagttttgcttaaaaaattcctccttttggctgggcacggtggctcacacctgtaatcctagcactttgggaggctgaggtgggcagatcacgaggtcaggagattgagaccatccttgctaatatggtgaaaccctgtctctactaaaaatacaaaaaattagccaagcgtggtggcaggtgcctgtattcccagctactcaggaggctgaggcaggagaatggcctgaacccgggaggcggagcttacagtgagctgagatcgtgccactgcactccactctgtgggacacaccaagactctgtcttagaaaaaaaaaatcctccttttcagtcaagttctcacttcgttgagagtgtgaccaaaatatagggccttagcatcactcttagttaccattgttttgggttccggttttagcacatcattcccactgttttgtgtttctggtttagcacgtcactcccattgttttgggttccggttttagcacatcactcccatgttttgggttctggttttagcacgtcactcccattgttttgggttcctatttaagcacatcactcccattgttttcatttccggttttagcacgtcactcccattgttttgggttccagttttagcaagtcactcccattgttttgggtttctggtttagcatgtcactcccattgttttgggttccagtttaagcacatcactcccattgttttgggtctctggtttcgcaggtcactcataggttacagtgtccttatggttgcacatttttttaaaatctcttgtcattccagttgaagagataccatttgacattttagagatgcctgcatgcaaactcgtaaaacatctgagtaagtacagtgcaccagggagactcttatgactactgggataataccaagaatttggtatatgctccttactcagggtccccataaatcaaaccacctaaaataaaatagattaaagaatgaattagataaagagtttacttgcttaactaagtgggttttttgttaattccctacaaccaaatttttataataccccatgttttctccacatgctgtaagtgttagcagctgcacagatacttaagataagagtctcatgatagtagagaagtcttgatctgtgatcttgggaaaagctgttcacattaaggatgccatcttcttctggggggaactgtccttgttagctttaccttaagggttccaatgggtatatggttccaagtgtggagggacccttctgagttgtgaaactatgaacccaaagtttaagtttttaaagttttgctgtcatgtggatggcaagggcagtccttctctgatgttctcagaagatccagtcatcagattctagattgtgaaggggttgactgtccccagtgaaccataaaaggctttctttacctggtgaaaatacacttcagggtaataatgtactgttttaacatcaactctctcgcatggaagagcttttatacaatcagaaagcatgcactgaaaatgacaactgaatgaaatccctttataaaatgtttaaatggcccatcaggtaatcaaatgtacctgaagttttgattgttttcctaggaatataggtttgacaaaccaaacattggttataaactattttagcagtttagaaatcaccacaccaatatatttaatttggatcattttctctttccatgatgagttatggaatgcagaacttttaataacaaaagttttaaggacttaagaaggataaggtggccatcctggttcttcataagtgtgtgcttaattaacattagacttacatcctcttgaataccagctgtttctccaaattaggtgcatggcactggtaactcatgagtagttataggtaatttgacttagaccatggagtttatttaaattatatatctaaacaatttcaatattggtgatttagcatgcaaatgtggcaaaatatttccttggtatacaatttttgttttacttgggttagaagttttataaaccagttggtctttttattaaaattttgggatttttttttttttgagacagagtctcactgtgttacctaggttggagtgcagtggcacaatcttggctcactgcaacctccacctcctgggttcaagcaattctcttgcctcagcctccagagtagctgggattacaggcacataccaccacacctggctaatttctgtatttttagtagaggtgggctttcaccgttggccaggctggtctcaaactcctgacctcaagtgatccactggccttggcctcccaaagtgctgggattgccgacgtgagctgctgcacccagcctaacttttgagaattcttaaccagtccaattcttggggtatcttggaacttatggggaatttttacccatgatattaaagttattagaaatctgtgttcacaagtgttttttagggtccttttcattctttcatgaatcttctaagagacaccatattctagaattttgcatgcttgtgaagtttttagaaactgcatcaccattaagcaattaactgtggaaatgactttaaatagttatagttaaagacaattgacaaggaaatttggttatttttgtggtctacaataacttaataaccataattagggtggatgtggtggctcatgcctgtaatcccagcactatgggaggccgaggtggaaggatcacgaggtcaggagatggagatcatcctggctaacacagtgaaatccgtctttactaaaaatacaaaaattagcctggcatggtggtaggtgcctgtagtcccagctacttgggaggctgaggcaggagaatggcatgaacctgggaggtggaggttgcagtgagccaagattgcaccactgtactccagcctgggtgacagagcaagactccatctcagaaaaaaaaaaaaaaaaaatcaagaattttagaaatcctatacaattttagaatggattgatgacatacactaaatataacctgaagaaggttcaacattattttttattttgacagtgctacccatgtgacttaacatgttaaatagtcctgtttacctctcttttgggtgcttcaggggcctctgtagtatcccaaagttagaggtcagaaaagacaattttgaagttgaaatttgattttgggaagcctattaaatatattaaaggtttaaacacttgatgttatgaaatagaattccacgtcaccataagtcattcatttacctaaaatcatgacttaaaaaatttttaaagggcaaaaatctttactcattgatagggggaagacttatcttcacaaacgatctgcctcttgtttttcctttttttttttttggtagtttatttacaaggcaaacaaatttttcatttttttattttattttatttattattattattattattattattattattattatactttaagctttagggtttatgtgcacaatgtgccggttagttacatatgtatacatgtgccagtctggtgtgctgcacccattaactcgtcatttagcattagttacatcttctaatggtatccctccccccttcccccacctcacaacagtccccagagtgtgatgttccccttcctgtgtccatgtgttctcattgttcaattcccatctatgagtgagaacatgcagtgtttggttttttgtccttgtgatagtttactgagaatgatgatttccaatttcatccatgtccctacaaaggacatgaactcatcattttttatggctgcatagtattccatggtgtatatgtgccacaatttctcaatccagtctaacgttgttggacatttgggttggttcccagtctttgctattgtgaatagtgccacaataaacatacgtgtgcatgtgtctttatagcagcatgatttatagtcctttggttatatacccactaatgggatggctgggtcaaatggtatttgtagttccagatacctgaggaatcaccacactgacttccactatcgttgaactagtttacagtcccaccaacagtgttcctatttctccacatcctctccagcacctgttgtttcctgactttttaatgattgccattctaactggtgtgagatggtatctcattgtggttttgatgtacatttctctgatggccagtgatgatgagcattttttcatgtgtcctttggctgcataaatgtcttcttttgagaagtgtctgttcatatccattgcccactttttgatggggttgtttgtttttttcttgtaaatttgtttaagttcattgtagattctggatattatcccgttgtcagatgagtaggttgcgaaaactttttcccattttgtaggttgcctgttcactctgatgacagtttcttttgctatgcagaagctctttagtttaattagatcccatttgtcaattttggcttttgttgccattgcttctggtgttttagacatgaagtccttgcccatgcctatgtcctgaatggtaatgcctaggttttcttctagggtttttatggttttaagtctaacatttaagtctttaatccatcttgaattaatttttgtataaggtgtaaggaagggatccagtttcagctttctacatatggctagccagttttcccagcaccatttattaaatagggaatccactgcttctttttgtcaggtttgtcaaagatcagatagttgtacatatgtggcattatttcggagggctctgttctgttccattggtctatatctctgttttggtacaagtaccatgctgttttggttactgtagccttgtaatatagttggaagtcaggtagcgtgatgcctccagctttgttcttttggcttaggattgacttggtgatgcaggctcttttttggttccatatgaactttaaagtagttttttccaattctgtgaagaaagtcattggtagtttgatggggatggcattgaatctataaattaccttgggcagtatggccattttcatgatattgattcttcctatccatgagcatggaatgttcttccatttgtttgtatcctcttttatttcattgagcagtggtttgtagttctccttgaagaggtccttcacgtcccttgtaaattggattcctaagtattttattctctttgaagctattgcgaatgtgagttcactcatgatttggttctctgtttgtctgttattggtgtataagaatgcttgtgatttttgtacattgattttgcatcctgagactttgctgaggttacttagcttaaggagattttgggctgagacaatggggttttctagatatacaatcatgtcatctgcaaacagggacaatctgacttcctcttttcctaattgaataccctttatttccttctccttcctgattgccctggccagaacttccaacactatgttgaataggagtggtgagagatggcatccctatcttgtacccgttttcaaagggaatgcttccagtttctgcccattcagtatgatattggctgtgggtttgtcaaagatagttcttattattttgagatacgtcccatcaatacctaatttattgagagtttttagcatgaagcattgttgaattttgtcaaaggccttttctgcatctattgagataatcatatggtttttgtctttggttctgtttatatgctggattacatttattgatttgtgtatattgaaccagccttgcatcccagggatgaaacccacttgatcatggtggataagctttttgatgtgctgctggattcggtttgccagtattttattgaggatttttgcatcaatgttcatgaaggatattcgtctaaaattctcttttttggttgtgtctcttcccggctttggtatcaggatgatgctggcctcataaaatgagttagggaggattccttcttcttctattgattggaatagtttcagagggaatagtaccagttcctccttgtacctctggtagaatttggttgtgaatccatctggtccaggactttttttggttggtaggctattgattattgccaccatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgagggatcagtggtgatatcccctttatcattttttattgtgtctatttgattcttctctctttttttctttattagtcctgttagcagtctatcaattttgttgatcctttcaaaaaaccacctcctggattcattaattttttgaagggtttttttgttgctatttccttcagttctgctctgattttagttatttcttgcctctgctagcttttgaacgtgtttgctcttgcttttctagttgttttaattgtgatgttagggtgtcaattttggatctttcctgctttcccttgtgggcatttagtgctataaatttccctctacacactgctttgaatgtgtcccagagattctggtatgttgtgtctttgttttcattggtttcaaagaacatctttatttctgccttcatttcgttatgtacccagtagtcattcaggagcaggttgttcagtttccatgtagttgagcagtttttagtgagtttcttaatcccgagttctagtttgatttcactgtggtctgagagacagtttgttataatttctgttcttttacttttgctgaagaggcctttacttccaagtatgtggtcaattttggaataggtgtggtgttgtgctgaaaaaaaggtatattctgttgatttggggtggagagttctgtagatgtctattaggtccgcttggtgcagagctgagttcaattccttggtatccttgtgaactttctgtctcattgatctgtctaatgttggcagtggggtgttaaagtctcccattattattgtgtgggagtctaagtctctttgtaggtcactcaggactggctttatgaatctggatgctcctgtattgggtgcatatatatttaggatagttagctcatcttgttgaattgatccctttaccattatgtaatggtcttctttgtctcttttgatgtttgttggtttaaagtctgtttcatcagagtctaggattgcaacccctgcctttttttgttttccatttgcttggtagatctttctccatccttttattttgagcctatgtgtgtctctgcacgagacatgggtttcctgaatacagcacactgatgggtcttgactctttatccaattagccagtgtgtgtcttttaattggagcatttagtccatttacatttaaagttaatattgttatgtgtgaatttgatcctgtcattatgatgttagctggttattttgctcgttagttgatgcagtttcttcctagtcttgatggtctttacaatttgtcatgtttttgcagtggtttgtaccgattgtgcctttgcatgtttagtgcttccttcaggagctcttttagggcaggcctggtgatgacaaaatctctcagcatttggttgtctgtaaagtattttatttctccttcacttatgaagcttagtttggctggatatgaaattctgggttgaaaattcttttctttaaaaatgttgaatatttgcccccactctcttctggcttgtagagtttctgccaagagatcagcagttagtctgatgggcttccctttgtgggtaacccgacctttctctctggctgcccttaacattttttccttcatttcaactttggtgaatctgacaatgatgtgtcttggagttgctgttctcgaggagtatctttgtggtgttctctgtatttcctgaatctgaatgttgccctgctttgctagattggggaagttctcttggataatatcctgcagagtgttttccaacttggttccattctccctgtcactttcaggtacaccaatcagatgcagatttggtcttttcacatagtcacatatttcttggaggctttgttcatttctttttattcttttttctctaaacttcccttctcacttcatttcattcatttcatcttccatcactgataccctttcttccagttgatcgcatcagctcctgaggcttctgcattcttcatgtagttctccagccttggctttcagctccatcagctcctttaagcacttctctatattggttattctagttatacattcgtctaaagttttttcaaagttttcaacttctttgcctttggtttgaatttttccctgtagctcggagtagtttgatcgtcggaagccttcttctctcagctcgtcaaagtcattctctgtccagctttgttccattgctggtgaggaactgcattcctttggaggaggagaggttttctgctttttagagtttccagtttttctgctctgttttcaccccatctttgtggttttatctacttttggcctttgatgatggtgatgtacagatgggtttttggtgtggatgtcctttctgtttgttagttttccttctaacagacagtaccctcagcttaaggtctgttggagtttgctagagacccattccagactctgtttgcctgggtatcagcagtggtgtctgcaaaaccatggattttcgtgatctgcgaatgctgctgtctgatcgttcctctggaagttttgtctcagaggagtacccggtcgtgtgaggtgttagtctgcccctactgggggggggttcctcccagttaggctgctcaggggtcaggggtctgggacccacttgaggaggcagtctgcccattctcagatctccagctgcgtgctgagagatccactgctctcctcaaagctgtcagacagggacatttaagtctgcagaggttactgctgtctttttgtttgtctgtgccctgcccccagaggtgaagcctgcagaggcaggcaggcctccttgagctgtggtgggctccacccagtttgagattcctggctgctttgtttacctaagagagcctgggcaatggccggtgcccttcccccagcctcgctgccgccttgcagtttgatctcagactgctgtgttagcaattagcaagatcccatgggcgtaggaccctccgagccatgtgcaggatgtaatctcctggtgcgccgtttcctaagcccatcagaaaagcacagtattagggtgggagtggcccaattttccaggtgccatctctcaccccgttccttgaccaggaaagggaactaactccctgacctcttgtgcttcccgagtgaggcaatgccttgccctgcttcggctagtgcacagtgcacttcacccactgtcctgcacccactgtctggcactccctagtgagatgaacccagtacctcaaatggaaatgcagaaatcacccatcttctgcgtcgttcatgctgggagctgtagagtggagctgttcctattcggccatcttggctcctcctcccattattttttaatattttctgaaaatcttctttaaagagagaaagccaaatgtcacccactttttcataaaaccttataggcaaatctattattcttttttttttttttgagatggattttccctctcgttgcccaggctggagtgcaatggtgcgatctcggtttactgcaatcccctgcctcccaggttcaagcgattctcccgccccagcctcctgagtagctgggattagaggcatgccccaccatgcccagctaattttgtgtttttagtagagacagggtttttccttgttggtctggctggccctgaactcctgacctcaggtgatccacctgtctcggcctccccaagtgttgggattacaggcgtgagccactgcccctggccatgtttttttttaaagatagcgtcttgctctgtcaccctcctcaccacattatagctctgggggccaagctgcatcacaatggaaatcatggagccacaggaagaatccactcagctttgcaagatgctgcccaaggggttgcttggagtaaccaaattaacatttttcattctgctcagagcaaaatacatgtgacaaaacatagacacgagccactttgcttagcacacagtgtcaaactggtaagactcaaacttgctcccagataggccgtgccatctctaaatctttttagaagcttctgcatattaataggcatccctaagtgagactaatttgggagccatcatttttaaatgcacttcatggcattattcatttggaatgttccactgtaagttatctttagtaagattttgccatttctgtaagactttgctgcttcccaggcctaatgaattagccagaaggaacttagttttccagaaattaaggatcctatttttacctaatatattggctttactcccaggttcccttgattgacttagccaatgatttttttttcctacctaagcatgcgaggaaaatgaaacaaaggggtagaacacaaaaatccctgtgaattttgaaaagccaaattttacaaccctccaatattatcatttgctaccactttccttctgacccattcagatgtagggggcctctaactggaactggattcaagccagttaactactggatcaaatctgatcctggacccggtcccgtttctgtcataacttctaaaacatccagccagtcatggctggatagcagtttggaacagaaatttgctcaaagaaactcagagctcaaaacacaaatccatggagctctgaaatccgagagagaatttaccacgatccccagctgctctgagaggtcaaagggcacaagtgttacagaatcctgaggcatcaattttctgcctgaaacctctggctggtggcacatttacctgtgttttgctcgagcccactgggttcgttctgtccactcggctcatgctagtggtctggatcccacacctgccaagggtgagctgggtacagagcagtgaagggtgtgtgagcaagcgagcatgggatctggccactgcacacagccaagcatgccagctgcagtggtgtgggcagctccaggcaccggcacaggtgccagctccctgtgaggctgcagctggaccaggccgactgcaaacagcttccactgtgggtatcagggaatgcagtggtgcccagaagcttagagatgcaggaactgcagagccccaaagaaggtgtcacagccctggcttggggagctcctaggtctgggctccctgaagggccacagctcttctctccttctctcttctcttcttcttgcctgcaatttggcaagcaaggggtgcgtttcagccctgtttatgttgcaactctttcagccctgctagttggcaggtcccgagttcttgtcctgagtccaggaagaatgaggtatgtgggcaagtagaaggtgagcaaggtgaagaggtgctttattgagcaacagtacagctcagaggagacctgcagtgggtagctcctttctgcaggcaggtcatcccaacgtctgttcagctctcagcagctgagagagacgcacggtggttagctgtgcacacgatgcccaggctgttcgagctgaggagtgccttcaggccagtgctgagccacccttagccccacctcaacctccctcctgtgctcgtcagtgcccaaagtctggagggggctgaggtggcagggggctggcatgtcagcactgccctgagcttgcacaaactgggctgggttgcgactgtacccgggttcagcctcaacttggatccgaagttggagtgggctctgggagcggagacgccaggtggtgggaccaggtacaactgagcctgcggggcaggggggcttgctgggcctctgagagtgcaaagatgcccgggtttgcagtcatggctggatggctgcagctgtgcctgggagggcggggctcctgcctaccaatttagaaggggtggggctcccccccccgttcctggctcccaccagcttcgaggagcgcacagccccagccactcctccccacagcagccagtgtctccgtagcaacttctccacgtgggccactgctgccatcacagagcagtccttgcaggtgcctttcttgtacctcagcactcctgggggtcattagaagccctagcaacactgctcaccacactataactccggaggccctagcagtcctgctaccacagatcccacttctgataccatctattaaaagaaaatcttcagctgaattaaatttaaaggaacttaattgagcaatgaatgattcacgaatcaggcagcccccagaatcacagcagatttggtgagactccagcacagctacatggtggaagatttatagacaataaagggaacgtgatgtacagaagtctgaagtgaggagtgaggtccagaagcacctgagtctgttacagttctcagcagtgaggtccagaagcaactggactggttacagtgctcagcatttgccttatttgaacacagctgaacactcagcagtgtgtgagtggcagaagtttggctgttgggattggtcaggactcagctatagttacaggcgcatactcctaagttaggttttcagtctttctacctattaagttaggttgcagtttgtccacagggactcaaatctagaagtacagagtccttcccaggccatatttagttcactgtaacagttcctattatgacctcactgacagttctttttctctgaattctcctttcttctcaacagcttatccaaatgttccgttggtccctgttcatcccgccctgcagttctccttgactgattcagccctttgtggtttgcagtcctgtttctctacagcttggaccccttcagtctttccatcataagtttagctctctgttgaatgcttctttgtagctacacaaaagttaccttaagctcaaaaaattcaaagtgaaagccacatcctcctctcttcccttatgtatatggtattactaccatgcagccagtgacccaaaatgggatttcttctgggcttttcttggttagattcaggctcatctggtgtcaagctttgttacttttgtttccttgttcttttatttttaattttttttcttttgagacagagtttcactcttgttgcccaggctagagcgcagtggtgtgatcttggctcgctgcagcctccacctcccgggttcaagcaattctcctgcctcagctcctgagtagctggtattacaggcatttgccaccacgcccggctaatattgtatttttagtagagatggggtttctatgttttgatcagggtggtctcgaactcctgacctcaggtgatccacccgcctcagcctcccaaagtgctgggattacaggcgtgagccaccgtgcctggcctgctcgttgttttcatctcatcctgatttctgaatacaggagaggagctgagttggtgttcactaacaagcacgaaagctttgttatatttacagtgtcattcttggcaaaacctgaatggtatgtttgtggggtgatgagattcagtcccctgtgacctgtacatctggccaaaactgtggtgacatccttaggaatccatggggagagagaaagcattcaggagttagtgggtcacgtttgacaagcgccaataaagaaatatgcaaagacaaaaaacaagaagaacattgtcatattttctaccttttgtctatataaatttatgtcaatgattctagcttatgttaatatgcaatgtatacaatatgctaacatatacaatatgtttttatagtttaaacatttctgtcatgttttcagattctttaaagattatattacgcttcctatttcagatagctgtttaaaatgagtaaggaaaaacggatgtgtatatcagttctaactgtttatggactaaaactaattgatttcttggttaagaacaaaaagtgacaacctaattactgaaaatgttaagtaggcaattatagttttagctttaacgtaaaatattaactatgctcctttcttgcatttttaacctaatactcaatataaatcgccacatgccatgtttcagatcaaggttctacttgtgatctctcatgagtttttcaaggttttaattatctgagatgtaacaatgtaccagtaaccttactggcttaaaccaggaatttattctttttacatgtcacaattttctttgtcaagacactggacagggtggtgtgggtttgttgcttcatgatctccctggtctcatctgtaaggactctagtggctggggacgtgaagcaggcacccagaaggactctagtggctggggacatggagcaggcacccagccctctctttgtggccagcacggacttcctcccagtctggcagtcaggtagtcaggtttgtctggcttctcccagggtgtgtgtccaagaggcccaggcagaagctgtaaggtctctcatgatcatccctcagaagtcccagagcatctctcctgccacactgtccagtcgtactcatcactgagatcagccatgattccaggtgggaaggtgattagattccacctcttgatgagaagcatagtaggaacctgcagcagtctttcataaaccacagcttgtcctctggccacaaactattaacgtttctcccacatggaaattatgctttgcccctctcaagagccccagaatggttttccttatggcactggctggtagcccaactgaatcctgaatcaggttgtggtggcctgtcatctgcacccacacacacagacacagtgaggactgaatcaggttgtggtggtctgtcatttgacccccgacacacagccacagtggggactgaatcaggttgtggtagcctgtcatctgaccccccacacacagccacagtggggactgaatcaggttgtggtggcctgtcatctgcgcccgacacacacagccacagtgaggggactgctgtgaaaacagtcgacatttccctttagaagctgttggtgggaggcaggagggaggtgctgccctgcaggccccgtttaacagttggtcattcccatggggcgcctgttacagttctgtgattagtgcccagtcctggtccctgagaacggcgcccagtcccggtccctgagaatggtgtttgtgtccttttactcctccctctgggcttttgtcattctccatgttctttttccttcagtgtctgggttgctgttgaccaactttccctgcctttttcttatggtcaatagggtattcaatggcttctttttcatttttttttccttttcttttcttttcttttttttttttttttactttggccttttgagacaagaaattatttctttatattttctctaaattctgtttgaaaactgaacctccttctttagatcatgtccctctcctgtcatatttattcaatgacagttaggggaggctggtagcactttccatgttcttcccagatgtctccttaggcagatccctgagatgatgcagtgccctttcagtttccatgttgtggtcgtagttttcccacagtccctcaacacgtaactctcaggccttttctccagtttccaatgacattttctcaccgtccttcaggccctgaccaagagtcttgatgcccttccaggttgcatgaatggtctccttgaggcccagttacaggtcagcctcacagtcgtggcacatattgtagcttctgattaccacagcagctcatttccagctgccatattctgttccagttatctgttctgaagaaaccatccccaaaagttggcagcttaaaacaactcattattacttgttgtttggcttagagagtcttggtggccagctcatctcacacacatttgcagccaagctggattgtgtgaaagcacagtggggtggtgtgcagggtggcccactagtggttgggagtggatgttgctggaggctcactagttgttgggagtcggtgttgctggaggctcagtgggggatgtcaatgcgtgtagctagtcatggactggccatgtggtttccatcatgaggtctcaggggagtgggatttcctgcctggtgactggctttctcctggataagtgttctgttttctcagcctggcttctgaagtccccaaataccacctttgtcaccttctgttggccaaacaagtcagtagtctgggcaaggtttaaggggaattggttctcacagagacaggagcaggaaagaatttgtcacctttagtctaccagaaatgagatttttataacaagtttgttccaaatacattccagttccccttgtgaatacttttttgactcacagggtatttcaaagtttattacttggctttcagacatttgaggcttttctggatatcaatttgttgttggtttctaatttaatttcaagtgttcagacaacatactttgtatactatttcaggcttgaaccttttctcaatcgatcgacatagagtctatcttggtactgccaagtaccatttgggtcaggattttgtcatttagatccgtatttttcctatatttttatctggttgttccatcagttactgagagagcagtattaattcaccagctataattttgaattgtcaatttcctgcttttgttctgttgtttttgattcacatacgttgaggctctgtgtgtgtgtgtgtgtgtactttgtgtgcactttgaggcacaatttataattgtaacatcatcgtctctgattcttttatttttattaaattaccctgtttatttctggtgatatattttgttctgaagcctctttcatctagtgttaacatctctgttgaagctttttctgattagtgtctgaatagcatatttttacgattagtgtctgcatagcatattttttctcatactttgtttgtgtctttgtgtttaaattgtgtctctgtggatgccatattgttgggtcttgccttcctctcaggtctggcagtctctgtcttaagtagagtatttgtccagttacattgtaactaatcattgctaaggttggatttaggtctgccatttttctagttattttctatttgtttgtttattatttttaagacagggtcttgctctgtcacccagactgtagtgcagtggtgcaatcttggctcactgcaaactctgcctcccaggtccaaccaatcctcgcttgagccccctgagtagctgggactacacgtgcatggcaccacacctggttaatttttatattttttgtagagatagggttttgccatgttgcacaggctggtcttgaactcctgagctcaagcaacctacccaccttggcctcccaaattgttcagattacaggcatgagccaccatgcctggccttcatctgtcttttgatcttctatatattctttcctaacttcttttgggttaaatatttctaaatattccagtttgattaatcttttggctttttgaaataattttttataggctgggcatgttggcttatgctcgtaatctcagctctgtgggagtccaagggaggtggattgcttgagcccaggagtttgagaccagcctgggcaacatggcaaaaccctctctacaaaaaaaccaaaccaaaatttagactgacatcttgatgtgcacctgtagtcccaactattcgggaggctgaggtgggaggattgcttgagcctgggaggttgaggctgcaatgagctgtgatcatgccattgcactcctgccagggcaacagagtaagaacctgtgtcaaaaggatcattttttataaataatttattatttcgaattttggtaacaaacacataccttaaaatttaccatcataaccagttgtaagtatagagttttgtagagttaagaatatttgcagtgttgtgtagcagatttctagattttttttttttatcctggaaaagtctatacccattcaagaactatttatttccccttccttccacctcctggcaagtactattctactttgtgtttctaaaaatttggcttatatacctagggttatataatatttgttgttttgtaagtaggttccatgttatgtgtcagatgtgtcaggattttcttcctttctatggctgaataatatttcttcatatatatatatatatatatttctctatctatatatatatctccttttgtttatccatctattcccggatggacgttttggtttcttccaccttgtggctgtgtaatgctcctgtgaacacataggtgtgaacatatctgtttgaggtcctgctactagttattttgtctctgtagaagttggatggctggatcatatggtcattttattttattttttttgaggagccagttcatatttccaccaacagtgttcaagggtttcagtttcacctgcacttgttactttctgttgggtttgaagtgatgtcccattgtggtttctatttgcatttctctaatgactagtgatgttacacatcttctcatatatctcatgtatctgttggctatttgtatatcatctttgcatctttggataaatgttctttgtccattttttaatcaatttattttgttgttgtgttgtagcggagttttttggtcatgaccattcatttatttcacagttcattcttgttacttgggccagggtcatgatcattcattatctctcagttcatcctcattacgttgggcaaacagtcatgctgcagggtatagattatgttattctgttactttcaggtagaattggggtctaggttctaattgtttctaagtttagattctgaatgagaatcagcagacgtagaccactgctgctgaggcctggggattgctgggaaaaaggcaggaaacagatacggacctgaccatggagggtttgtgtttcacggctcccatctgggtacccaaggaacctacatgtagctcgtgtgtggagagcctacattgcccactcaaagcaattgaggatggaacggtcttggggctggagctcattatttggaatgataaccacatctgcacagagaggagctgataagatgttgtccttccatgtatatctgggaatactgtgtagggtctctctgtaaggacaggggcagtattggctccttggcctctagttaacctcacaagtagtctagtaaaggctttgcaaacttgtcaccatctgtggacattctggccagctcttgttttcaccctactgacttcttcagacactaggcttttgctttagaccattcatggtttttcttcctcttcaaatcagtaatcaataaatactcttcaagtcaataaatttccactcctttaggaaaccctgatcttcgggtcgcaccacaaggtttaattaactcgtttgattgtttttctgttttcttgggtttttttttttccttcttcctgggggtttctagtaattctagtttgatgtctcactttctccattttttatttcttagttttcttctgtgattattttcactgcagttgcagggcctaatcctgggttggcagagaactagcacttactctgccctaattagaatccaggagagataggaggtgccctagtgtgaaaatgtgtttgctcctctctgcttctggtagtctctctgtaggagttctttacgtattctgaatgttcacttcttatgagatacatgatgagctactataggttgaatgtctctgatccaaaaatctgaaatcccaaatgctccaaagtctgaaactttttgagtgccaacatgacactcaaaggaaatgcttattggagcatctcagactcgggtgtttgaattcgagatgttcaaccagtaagaataatgcaaatattacaaaatctgaaatacatcccaagcatttcaaataagggacactcaactggtattttcttttattctacagtttgccttttaccctgttggttgtgacctttgaggaacagaagtttttaggtttgatatatttttgcttttactgcctgagattttaatgtcatatcctaaaaattattgacaaattcaacgtcataaggcattttccaaatttgttttccctaggagtttgatagttctagttttacatttaggtttataattcactttgaattaattttaacatggtgtaaggtaagagtccaacttcattgttttgcatgtagatatacaattttcccaacaccatttgttgaagaaagtgtccttcgccattgagtggtcttggcatccttgtggaagatcactggaccatatatgccagggttggtttctgaggtctccgttgtgttggtccataagtgggtcaagagtgtctttttgccatgaccacatattttttttttggcttattgtagttttgtaattgttttgagacctttaattttgttttgtttcaagactgatttgcctattcatgggccccatagattccatatgaattttaggataggattttctgtttatcaaaaatgtcattggaatctttataaggattgtattgaatctaggtcacttcgagtagcgttgacatcattccaagatgaaatcttttaatctgtaaacccagcttttcttttcatttatttgtgtttaatttcttttaacagtgttttgtagttttctgtgttcaaatcttttgccctcttggttaagcttatttctaattttcataatgttgttgtaaatgtaattctttttttttttttttttgagatggagtcttgctctgtctcccaggctggagtacagtggcactatctcaggtcactgcaacctgcaccttccctattcaagcgattctccaacctcagcctctcaagtacctgggatcacaggtgcgcgccaccatgccaggctaattttttgatatctttagtagagacagggtttctccatgttgaccaggctagtcttgaacttgtgacctcaggtgatctgcccactttggcctcccaaactgctgggattgcaggcatgaaccaccgcacctggccaaatatcattctttttaaaaatttcttttcttttgttttctcttttcttttcttttcttcctctctctttctttcctttctttctttttttttgagaccgcatctcactctgtttcctaagctggagtgcagtggcacaatctcagctgactgcaacctccaccttccaagttcaagcaattctcctgcctcagcctcccaagtagctgtgactacaggtgtctgccactacgcccagctaatttttgtatttttaatagagatagagttttactatttatattagagatgaggttggcccagctggtcacgaactcctgacctcaggtggtccacccaccttggcctcccaaagtgctgggattacaagtgtgagccactgcacctggcctctttttaaaattttatttgcagattgttcattgttagtttatagaaatgcaactgacttgtgtgtgttactgtatcctgaaactttgttgaatttcattattctaccagtattttgtggaatttcaggatttttacacattacatcctgttgtctgtgaacaaaattttgtactttttcctttccaatttgcatcctttttattactttctcttgcctaattattctgagtagaaattccagtactgtgatgaatagaagtggcaggaagaaatgttgctatcttattcctgatcctagaggaaaagattttagtttttcaccattgagtatgatgttagctgtgaggctttcatgtataatctttatttattgaggagtttccatatattactaattctttgagtgtttttattacaaaaagtgttcatctggctctggaaccagataaacgttgacctgatagaatggattggaatgtccccttctggtttttgaacatttttggaatattttgcagaggattggcattaattcttcttgaaatgtttggtaaatttttccagtgaagttatctggacctggaattttcttttttggggggtttttgattactggttgaatcttcttactagttacaggtctctttggattttttatttctccctgatgcagtatggcggtttgtgtttctaggaatttataaatttattctaggttgcccagttttgtggcatatggttgctcacattagtctcttgtaatctttttcatttttgtgacatctgttgtactgtcacctcttttatttaagattttagcatttgagatttctctttttttcttaatatagctgtgagttttaaaatttttattgatctttaaaaaaaacaaactcggtgttttttttcctttttttctggtcttattctgcttatctctgctctaatctgttattttcttccttttgcttggtttgtcattagtttttttttttccccccttcaggtgtaatgttaggttattgatttgagatctttcttctttttaatttaagcacctgcagctataagcttccctttagcatgggtttgagatctttcttatttttaatttaagcatctgcagctgtaagcttccctttagcactgcctttgttgcctcctcctgagtttgggtatgtcatggttttcatttgcttaaacattttttgtcctattgcaatataattgtgttgtttttaataaaggtaattaatgaaacccataatgaattgtgcttctgtttttataatattttaagcattcttaactcagaaatgtaaattttagaaaaaaattccaggccaggcacagtgtctcacacctgtaatcccagcacttgaggaggccgaggcgggaggatcatctgaggtcaggagttggagaccagcctggccaacatggtgaaaccctgtctttactaaaaatagaaaaaaatatataaaagttagctgggtgttgtggtgggtgcctgtaatcccagctactctggaggctgaggcaggagaatcacctgaatctgggaggcggaggttgcagtgagctgagattgcaccactgcactccagcctgggtgacagaatgagagtccgtctcaaaaaaaaagaaaaaagaaaaatttcagacatatttatttgtatttcaatttagaaactatgatctcctaagtgtattgacacaggaacctgacataaagataaagaataataagcatataacaaaacggaaacttgcaaatacctgttttttattaatttttaattatatatatttaaaaattgccgggtgcagtggcttacatctgtaatcccagcactttgggaggctgaggtgggcagatcacatgaggtcaggagtttgagaccagcctggccaacatggtgaaacctcatctctattaaaaatcaaaaaattagccaggcatgatagcatgcatctgtattcccagctactcgggagactgaggcaggagaattgcttgaacatgggaggcagaggttgcagtgagccaagatagtgccactgcactccagtctgggtgacagagtgagactctgtctcaaaaaaataaaaattgtctgggcgcggtggctcacaactataatcgcagcactttgggaagctgaggcaggcagatcacgtcaggagatcgataccatcccggctaacacggtgaaacgccatctctactaaaaatacaaaaaattagttgggcgtggtggtgggtgcctgtagttccagctactccggaggttgaggcaggagaatggtgtgcacctgggaggtggagcttgcagtgagccgagattgcgccactggactccagcctgggtgacagagcgagactctgtctcaaaaaaaaaaaataaaacaaaataaaactaaggtgtggttgacatacaaaaattacacatatttaatatataccgtgtgtgtgtgtgtgtgtgtgtgtgtgtgtgtgtgtgtgtgtgtgtgttacggaggttttacttttgttgcccaggctggagtgcagtgacacgatctcagctagctgcaacctccgcctcccgggttcaaacaattctcctgcctcagcctcctgagtagctgggatcacaggcgtgcgcccccatgcccggctaattattgtatttttttagtagagacaggatttcatcatgttggccaggctgatctcgagctcctgacctcagatgatccacctgcctcggcctcccaaagtgctgggattacaggtgtgtgacaccgaatatatacatcttaatgagtatagagataagtattcgccccaggtctcatcacaacaaataatgccgtaaacttgaccatcactccccatatatttctcattctcaccctttttaaaaaatgagaccgggagtggtggctcacgcctgtaatcccagcactttgggaggccaaggcaggtggatcatgaggtcaggagatcaagaccatcctggctaacacagtgaaaccccgtttctactaaaaatacagaaaattagccgggcatgatggcgggcacctgtagtcccagctactcgggagacagaggcaggataatggtgtgaactcgggaggcagagcttgcagtgagcctagatcgtgccactgcactccagcctgggcaacagagtgagaatctatctcaaaaaaaaaatgagatgaccatttcacctaaaatatatcctcttaagttttttttttaagtgtacaatacaggacggccatgcatcagagatatatctgggttcggttccagaccactacaataaagtgagttatacaatctcttttggtttcccagtgcatgtaaaagtatgtttatattgtgctgtataaagtgtgcaatagcatatgtctacaaagtgtgcacactttaatttacaaatactttattgttaacatgtgctaacagtcatctgagccttcagaaagctgcaatctttttttgtgtgtgtgacagggttttactctgtggctcaggctggagtaattgcagcctcaacctcatgctcaatcaaacccccacctcagactcctgactagctgggactacaggtgcatgcaaccatgtccagctaatttttgtattttttttttgtagagatggggttttgccatgttgctttgatgttctgggctcaagcaatccacccaccttggcctcccaaggagttgggatgacagttgtgagccactgcacctggccaagtttcagtcttcttgctgatggagggtcttgccttaatgtaaggtggtggttgctgagcgttggggtggctgtggctatttcttaaaataagacaccattgaagtttgctgtgtcaattgactctccctttcacaaaagaattatctgtagcatacgatgttgtttgatagctttttacccacagtagaactttcaaaattggattcaatgctgtcaaaccttcgtactgctgtaccaactaagtttatgtattattgtaaaccgttgggttcaattctgtcaagccctccttctgctgtaccaactaagtttattctaaatctgttgtcatctcaacattgtttacactgtcttcaccacgagtagatttcatctcaagaaaccactttctttgctcatccgtggaagcaactcatccactcacgttttctctggagactgctgcagtctcgccagatcttcaggctctgtctctgattctagtgctcttgttatttccaccatatctgcagttacttcctccacagaagtcgtgaacccctgtgtcatctgtgagggttggaataatcttcccaacttctctctctctcttttttttttttttttttgagatgaaatcttgcctgggctggagtgcagtgatgcgatctcagctcactgcaacctccacctcccgggttcaagcaattctcctgcctcagcctcccaagtgtttgggattacagtcacccccgaccagacccagctaatttttttgtgtgtttttagtacagacaggatttcactatgttggccaggctggtctcaaattcctgacctcgtgatccacttgccttggcctcccaacgtgctgggattacaagtgtgagccaccatgcccggccccaacttctcctaatgttgctattttgatcttcttttttaaatcatgaatgttctcaatggcatctagaatggtgaatcctttccagtaggttttcaattattttgcccatatccatcaaaggaatcactttctagagaagttatagctttatgaaatatattttttaagtgataagacttgaaagttgaaattattctttgatccaagggcaccagaatgaatgttgggttagtaggcatgaaaacaatgttcagctctttatacatctctgtaaaagcccttgagtccaggggcattgtcagtgagtggtaatactttgaaaggaatcttatttcttgagcagtaggtgtcaacagtgggcttaagatattcagtaaaccatatttgtaaaccgatagtctgtcatccaggctttgttcccatttgtagagtataggcagagctgtgttttatcataattcttcagggcccttggattttcagaatagtaaatcatcattggtttcaagttaacatcaccaactgcattaggccttaacaaaagagtcagcgtgtcctttgaagccttaaatccaggcatcaactccactctagctgggaacatcctggatggcatctccttctagtagagggctgttttgtctccattgcaaatctgtttagtgtagccatcttaatcagttaccttctagatagctttctgcagcttttccatcagtacttgctgctttatcttgtgcttttatgttatggagatgacttttttccttaaacctcaagaaacaagctcttctagcttcagacttttcttctgcagctgcctcacctaagtcttcatagaattgaagagaggccgggtgcggtggctgtcacacctgtaatcctagcactttgggaggccgaggcaggcagatcacctgaggtcgggagttcaacaccagcctgaccaacgtggagaaaccctgtctctactaaaaatacaaaaaattagccaggcgtggtggtgcatgactgtaatcccagctactcgggatgctgaggcaggagaatggcttgaaattgggaggcagaggttgtgatgagccaagatcacaccattgcactacagcttgggcaagaagaatgaaactctgtctcaaaaacaaagaaaaataagtaaaaagagagttaggcttgggcttaatggaatgttttctgtttttttttttttatcttctatctagaccaattaaactttcttcataacagcagcaagattgtttagctttttatcattcatgtgttcactggagtagtactttaaatttctttccagaacacttcctttgcattcacaacttggctaagtgtttgttgcatgagttctagctactgacctgtcttgcttacagcatgccttcctcactaagcttaattatttcttccttttggtttaaagtgacagacatgcaactcttctttcgcttgaacatatagaggctattgtagggttattaattggccacattttaatattaataaaaagaagcctgagaaaaagtgagagaaagagaaatgtcccattggtggggcagtcagaacaaacgcatttgtcaattgtttgctgtcttatcctggtgtgatttgtggttcccaaaacaatgacaacagtagcattaaggatcactccttacagatcaccacaacagattcaataataaaaagcttaaaatactgtgagaataaccgaaatgtgacacagagacatgaagtgagcacgtgctgtaggaacaattgtgccagtgagacctgcttattgcagggtggccacaaaccttcaatatgtaaaacacatggtcacaaaacacaataaagcaaagtgcagtgaaacaagatgtgtctgtcttttgatagactctgacaatctctatctttgaattggtacattcataccattaacattcaaaatgattattgatatcattggattaatatctactatatttgttactgttttctattcattctcctcagtcttcattcttttttctaccactctttttctgccttttgcagttttcattgatgattttagatgactcctgtctttcttagcacgtacttctctttttaaaactttttttttaaccagttgccacagaatttgcaatatacatttacaacaaattcaagtccactttcaaataacactatcccactatcccacaaataagactacctgctcaacaaacaaaacacctaattcctcagtaacatttacaaccaattcaagtccactttcaaataacactatcccacttaacgggtgactacctgcttaacaaagaaaacacctgattcctccctcccatccttccattccattccttgtattattgttccttatttcacttgtgtataagcatacataatctatttgtgtgtatttattattatctacaaacttattggtcaaatcaattatgaataaatacatgtttttattgtaccacaattcctccctcccatccttccattccattccttgtattagtgttactcatttcacttgtgtataagcatacataatctatctgtgtgtatttgttattgtctatgaacttcttggtcagatcaattaagaataaatacataggtttttattgtaccacaattctttctttaatgctctttttaaaaaaatgttgatccaggtttcagttatatatcttttgtttccctctaaagaatttcatttaacatttcttgcaagacaggtctcctggcaacaagtttcttgaatttttatttttctgaggaaggccttaattctccttcacttttgaagggtggtttcagtgggtacagaaacttaggttggtgggtttttttctgtcaacattttgaatttttcatttcactgtcttgctttcacagtttctgcaatgttgaatgcagttcttatctttgtgtctctgtaggtaaggtgttttctgccccacttctggtttctttcagagttttcctttatcttttatttcatatagtttgaaaattatatgtccaagtgtaggttgttggcatttattctgcctggtgttctcagagcttcctggatctttggtttggtgtctgacattaacactggaagttctcagacatggttgttgcagaactttcttctatttcttctcctcctggtattctcattactctgtttcaccttttgtagttgtcccacagtcttggatatcatcttctgttcttttcagtgtgtcttttctttagttttcgaaatttctgatgataaatcctcaagctcagagattctttactcggctgagtccagtctactaataagccatcagaggtattcttcagttatttaccacattttttatcactacattatgttgaaggttcttacgatgtctgtctttctgattacattacccatctacacttgaatgctgtctacttcattcgttaggtccttagcatagtctccagaggtttaaaaaaaattccaaaatcatatctttgtctgcttctgaagcttgctctgttgacacaaattgtagttttttctttttttggattttagtatgccttgcaattttttccctttattctcatgcatgaagcacccactaaaagtgactgttgttagtatagcttcagtaatgcggtgatgaggtgacagggcaggtgatgctctcttagtctctttaggctactataacaaaatactttagactgagtaattcataaacaacagagattattgctcacagatctggaggctggaaagttcaagactaaagggccaggatatttggtgtttggtgaaggtcaaacattcagacactcgcaatgaatatagcgacagcagcagtcttcaggaatcctatgtgagggacaaacactcagaagccagctggagtgttctagaatcctatgtgagggacaaacattcagaccccagcagtagtgttgtggaatcctatgtgagggacaaactttcaaacccttgtaacagtgttctggaatcctatatgagggacaaaaattcagaacctcgtagcagtgttctggaatcctatgtgagggacaaacattcagagcccagcagcagtgttctggaatcctatgtgagggacaaacattcagaccacagcaggagtgctctgtaatcctatgtgagggacaaacatttcaaaacctcatagcagtgtgctgaaatgttatgtcagggacagacatttagaccctcgcagcagtgttctagaatcccatctgcgggacaaacattcagacactcgcagcagtgttctggaattctatgtgagggacagacattcaaaccccaacagcagtgttctagaatcctatgtgagggacagacgttcagaccccagcagcagtgttctggaatcctatgtgaggggcaaacattcagaccctcatagcagtgttctggaatgctatgtgaagggaaaacattgagaccctcctaacagtgttctggaatcctatgtgaaggacagacatttagaccctcgaaacagtgttctggagtcttaagtgagagacaaacattcagaccctcgtagcagtattctggaatcctttttgagggacagacattgagaaaccagcagcagtggtctggaatcctattttaggggcaaacattcacaccccagcaacagtgttctagaatcctatgtgaggggaaaacattcagaccacggcagcagtgctcaggaatcctatgtgagggacaaacattcaaaccacagcaggagtgttctggaatcctatgtgaaggacaaactttcagaccacagcaggagtgttcttaaatcctatgtgaaggacaaacattcaaaccccaagagcactgttctgaaatcctatgataagggctaaaactcagaccccaacatgaatgttctggaatcctatgtgagggacaagcattaagaccatagcaggagtattctgcaatcctatgtgagggacaaacattcagaccccagaaggagtgttctggaatcctatgtgaaggacaaacattcagaccctcgtagcagtgttctggaatcctatgtgagggaaaaactttcagaccacagcaggagtgctcgggaatcctatgtgagggacaaacattcagaaccttgtagcagtgttctggaatcctatgtgagggacaaacattcagaccctcccagcagtcttctggaattctatgtgagggacagacattcaaaccccagcagcagtgttctggaatccgatgtgagggacagacattcagaccccagcagcagtcttctggaatcctatgtgaggggcaaactttcagaccctcgtagcagtattctggagtcctatgtgaaggacagacatttagaccctcgaagcagtgttctgcagtcttaagtgagggacaaaaattcagaccctcgtagcagtgttctggaatcctttttgagggacagatattgagaccccagtagcagtggtctggaatcctatgtgagggacaaacattcacaccccagcaatagtgttctgtaatcatatgtgagggacaagcattcagaccccagaagcagtgttctggaatcttgtgtgagggacaaacattgagaccctcgtagcagtgttcttgaatcctacgtgagacacaaacattcgtaccacagcagaagtgttctggaatcctatgtgagggacaaccattcagaccacagcaggagtgttctggaatcctatgtgagggacaaatattcagaccctcatagcagtgttctggaatcctttgggagggacaaactttcagaccccagcaggagggttctggaatcctgtgtgagggaccaacattcagaccctcgtagcagtgttctggaatgctatgtgaaaggcaaccattcagaccctcatagcaatgttctggaatcctatgtcagggacattcagaccccagccgcggtgttctggaatcctatgtgacagagaaacattcagaccacagcaggagctttctggaatcctatgtgatggacaaactttcaggccatagcagtagtgttctgcaatccaatgtgagggacaaacattcagagcccagcagcagtgttcaggaatcctatgtgagggaccaacaatcagaccctcgtagcagtgttctgtaatcctatgtgagggacaaacattcagaacccagccgcagtgttctggaaatctatgtgacaaacattccgaccacagcagcagtgttctggaatcctatgtgtggtacaaactttcagaccacagcaggagagttctggaatcctatgtgagggacaaactttcagaccccaggagcagtgttctgaaatcctatgttcagggcaagcatttacatcccagtgtgaatgttctcgaatcctaggtaagggacaaacattcagaccacagcaggagtgttctcgaatcctatgtgaggaacaaacatttagaccaaagcaggagtgttctggaatactatgtgagggacaaacattcagaccctcttggcagtgttctggagtcctatgtgagggacaaacattcagaccctcttagcagtgttctggaatcctatgtgagggacaaatattcagaacacagcaggagtgctctggaatcctatgtgagggacaaacattcagaacctcgtagcagtgtcctggaatcttatatgagggagagacatttagaccctcgcagcagtgttctggaatcccatgtgaggggcaaacattcagaccacggaagcagtgttctggaatcctatgtgaaggacaaacattaagactctcgtagcagtgtcctggaatcatatgtgagggacaaccattcagacaccagcagaagtgttctggaatcctaggtgtgggaaaaacattcagaacctagtagcagtgttctggaatcctatgtgagggacatattcagaccacggcagcagtgttctagaatggtatgtgaaggacaaacattcagacccttgtagcagtgttccagaattctgtgtgagggacaaacattcagaccccaagagcagtgttctgaaatcctatgttaagggaaacattgagaccccagcatgaatgttctggaatcctatgtgagggacaaatattcagaccatggcaggagtgttctggaatcttatgtgaggaacaaacattcagaccacagcaggagtgttctggaatcctatatgagggataagcattcagaccctcgtagcagtgttctggaatcctatgtgagggagaagcattcagagcacagcaggagtgctctggaatcctatgttagggacaaacattcagaacctcataacattgtgctggaaacctatgtgagggacagacatttagaccctagcagcagtgttctggaatcccatgtgagggtcaaacattcagatcctcgcagcagtgttctggaattctatgtgagtgacacacattcagactccagcagcagtattctgtattcctatgtgaaggacaaacattcagaatccaggagcagtgttttgaaatcatatgttaagggcaaacatacagaccctagcatcaatgttctagaatcatatgtgagggacatacattcagactctcgcagcagtgttctggaatcctatgtgggggacaaacattcagacaatggcagcagtgttctggaatcctatgtgagggacaaacactcagagccttgtagcagtgttctggaatcctatgtgagtgagagtgcctggagcctacccaacctgacgcccccaaagccctcacagggtctgacctcccagcatgcacctgcctctctctgaaccccaactgcccaccctgcctgttccctggccccctccatcctgtgcagcccatagactgtgaccatctctccagccactctggtctttcctttacctttgtcctgtcagaatctctgagcaggatctcccaagtccatccaaacacgtgctttgtccacttttgactaggcccttgggcatcactgggctatcccagctgtccacagggccttcaataatgcacattgcacctggcttatccaagcagtgctcagcagcccacattgaccaggtccctgctgaccagaccacgcacatcaggtcctccctgacagcaccctcactgattagaccctcatgaccaggccccactaacaaggcccccactgccaggcacacaatgacaaggactccactgaccaggaccttactgacaaggcctcactgacaaggcctcacggaccaagtccttactgacaagtcctcactgactaggtgattattgataaggcctcactgatcaggttccactgatcatgacctcattccctggccccaaagatgaggccccactgaccaggcctccagggaacaggttgtcactgatcaggcccctaataaccaggcctaaggtcaccagatgcccctgactgggaccctagtgagtagaccccactgaaccagcaccaaatgctgagatccctgctgaccaggtcaccctgtagaccagtgctacaaaagtcaccactgaccaagtcctctctgaccaggacgctacggattaggtcccactgacaagggcctcactgatgaggacacacccaccagggtctgctgactaggtcccatgtgcccagtcctccactgaatagcaccccttgacctggtcaccagtgccccagcccatgctgaccagaccagcactgagccccagctgaccaggtctccactgatcaagccccacagcccaggtttgcactgaccagacaccaaacaactggaagccaataggtccccactcaccaaaacccccactactagaccccactaatgagaccctctctaagcagacctctgctgaccacgatcccactaaatagtcctcactgacctaggtccactgaccaggcccacactgatcaggcccctcctaaccacaccggaaatccaaggggcaatgacaagtttcatatggcaaaagttggaacaagacagagagaggaaagaggttccacagccttttaaactactagatctcatgagaactcactcactatcaggaggatggcattaacggcttgctgctttgccatttgtgaaggatccactcccacccctttatgattaaagctttttccacctaggccccgactctaacattagggagtgtactttcacatgagttttggaaggggcatagagaaaaaccgtattattctgtccctgaccccacaaatctcatgtccttctcacactgcaaaatacagtcatgccctgccagcagtctcacaaagtcttaactcatttcagcattaactcatagttacaaagtccaaagtctcatctgggtcaaggctacattctcttttgcctacgagtctctgaaataaaaagcaagttcactgcgtctaaggtacaatgatggtacaggcattttgtaagctttccatatccaaaagggagacattttccagaaagcttcttatttttatctgaggccctctcagcctggccttcactgtccatgtttttgtcagcattcttgtcacagccatttaaccagtctctaagatggtccaaaaatgctctcatctatctgtcttctttggagccctccaaactcttccaacctctacccattaccgagttccgaagttgcttccacattttcaggtatctttatagcaatgctgcagtcctcatttgccatttttggtaagatttattttgaaaaagaggtttaattggctcatggttctgcagagtggacaggcagcttagtgcttctgcttctggggggcctcagaaatctttcaatcattgtgcaaggtaatgaaagagtgaattgtctcacatggcaagaggaaatcacggagagtagggagtgatatagagttttcagtggccagatctcacgagaattcactcataattgtgaggacagtaccaaggggatggtgctgaaccactcatgagaaattcgccttcatgattcaatcaccttatacgaggatccacctccaacattaggaagcataactcaacatgagatttggtggggacacatattcgaattgcctcatcagtctttgagtataaagacatccatagcaggctttatccagccaacttctttgggattctttatagggtttcaggtctatagcatatccactaaaatatccctacttcaaaaggcaataaagtaagtggtattatcattcttcaaaaagttataatggtagtgtaggcattcatagtatgatttagttcatttgccactctttctattctatcaccatattaaccctttcctacacaattctatattcagctgggtttcagttgagcacaaagtcatccttgtactaccaccgatagctggcactagctctttgatactgttatcattctgctgtagaaagtacccgtgaactggaaaaagtccacaatcgaatagctagtcattcaacactatcaaattttaggtgactttttgaaaaaatagtatctcttgttgcaagaaatgctccatctgtgatttcaagtctctcactcgagtgaattggatggaagtggtgaatttcagccaaagtggccaaagaaatcctgttcctgtgataatgacaccatcagcctctgcacctctgtcttcccttctgccacatgttgcctgttctccgtgactttggtaagagcttccttgtgtatgaggatgatgtccaggatgttggtctggtgtccctgagacagcactaacaggtccctggctgggtccaggtccttcctggactgattggcaaggagcttactgatgttcttgaaggcatctctggtgaagtggatggcctagtcaagttccaaggcctggctgaggctgaagaaaaactggccatcttctgatgctctttctaaaagcctgtcactgtcatctgcttgcttgtcaactcattggctgtgaggttgagctgagtggcctgtgtccatcttcttggggaagcatttgaagccatcagtcttgctctcccacccctaaaggttgatggtcaccacctggggttgtactgagggtcagaaagaagccggcactcactatctcatccttctcagccttcctcttgcactctctccaggctgtctcttcagtgctggtgggatacatcagaaagtgatggaagatgtggcactgtgcccacacccagaagctggccatgtggttggctcatccaccagaatggatgctctgggtgctctttgagccagcttggccttgcctggcatgcacaggccccaggtaccgacatgttgctccgagtgagcttgtcctgctttggaccaaattctgtcaggccagggccacaaaaggccgagtcccacgggtggtaatcctggctgctttctgcacttccacataaagacctcctgaagatggcctgtggtctacctctttgcaaccaagaagcccgcagtgccatatgaaccctcaggcatggactggagcccccaaggaagcacacaccctgctcctgagtctgctgctcattttctctgtgtggctccatttgtgtcacagttgttgcacagacttgagcatgccgggcaaggccaagctggctcaaaaagtaaccagccacctctgcaaggttgtgccaggagccggtggaccggccaccaacgtcactcgctgctggtaaggttacatcagttcttctaccctagaggtagggccccagtgccatatgcttttcctcaggcctctgctctatcagtcataggcggcaaccacacaggctgtgggaacatggccatccctccttccttgagtagctgaggttgctggcttgtctgcctgctacaggcacagccttgtagaggtggctagttgctctgagccagcttggccttgtctgacatgcataggccccaggtactgacactctgctccgagtaagcttgtcctgccttgggtcaaattctaaatctggccagggccacagaaggcccagtcccttgggtgctaatcttggctgctttctgcacttgaacataaagtcctcctcaagacagcctgtgttctgcctcttggcgaccaagaagcctacagtgccatatgagccctgaggcatggactggagccacaaaggcagtgcacgccccgttcctgagcctgctgatcatttcctctatatggctccatttgtagcacacttgttgcagtgaggcttgtgcatgccaggcaaggccaagctggctcaaagagcaagcagccacctctgcaagggtgtgccaggcgcagatggtccagccgccaacctcactcactgccagacgtggtacatcagttcttctaccctaaaggtggggccaagaggcagaccacaggccgtcttgaagaggactttatgttcaagtgcagaaagcaggcaggattaccaccctgggtactcgcccttctgtggcccgcagtgccatatgagccctgaggcatggactggtgccatctgcttcatacaaaaattaacttaagatggattaaagagttaaatatgccacctgcttttcctcaggcctctgctccatcaggcatcaggtggcagctactcatgctgttggaacctggccatccgggcttccttgagcgggtgaggttgctggcttgtccgcctgctacaggcacagccttgcagaggtggctggttgctctgagccagcttggccttgcctggcatgcataggccccaggtactgacactctgctccgagccagcttgtcctgccttgggccaaattctaagtctggagaggaccacagaaggcagagtcccctggatggtaatcctgactactttctgcacttgaacataaagtcctcctcaagacagcctgtggtctgcagctaggcaaccaagaaacccgcagtgccataggagccctgaggcatcgactggagccccaaaggcagggcacaccctgcttctgagcctgctgctcgtttcggctatgtggctccatttgttgcacagttattacactgaggcttgggcatgctgggcaaactccaagccacttagaatttggtccaaggcagaacaagttcactgggagcagcgtgtcggtacctggggcctatgcatgccaggcaaggccaagctgccttaaagagcaaacagcctcctctgcaagggtgtgccaggagccggtggacccaccaccaacctcactcactaccggtcagggtacatcagttcttctaccctagaggtagggcccaactgccatctgcttttcctcaggcctctgcttgatcagccatcaggcggtggccactcatgctgtgggaacctggccatccctgcttccttgtgtagctgaagttgctggctgctccacctcatccaggagcacccttgcagtggtggctggttgctctttgagccagcttagccttgcctagcatgtacaggccccagctactgacacactactccgagtgagctggtcctactttgagccaaattctaagtctggccggggccacagaaggccgagtcccctgggtggtaaacctggctgctttctgcccttgaacataaagtcctcctcggctggtctatggtctacctcttggcaaccaagaatcctgcagtcccatacaagccctgaggcatggactggagccccaaaggcagtgcacaccctgcttctgagcttgctgctcatttcctctgtgtggctccatttttagcaaagttgttgcattgaggcttgtgtatgccgggcaaggccaagctggctcaaaaagcaaccagccgcgtttgcaagggtgtgcctgaagtgattggactagccatcaacgtcgcccactcaaggaagcagggaatgcttgtttgtaccatgcatttcactacaggtcatttcccctgaggttggtggcctaggttttcttctagattttttatggttttaggtcttacttctaactctttcatccatcttacttaatttttgtttaaggtgtgtggttgtggcccagtttcagttttctgcatttggctagccagttttcccaacaccatttattaaatagggtatcctttcccattgcttgtttttgtcaggtttgtcaaagatcagatgcttttagatgtgtggtgtcatttctgagggctctgttctgttccattggtctatagatctgatttgttaccagccccatgctgttttggttactgtagccttgtagaataatttgaagtcaggtactgtgatgcctctagctttgctgtttttgcttaggattgtcttggctatgtgggctcttttttggttccatatgaaatttaaagtagtttttctaattctgtgaagaaagtaatggtaacttgatggggacagcaatgagtctataaattactttgggtggtatagcagtcaggcacagaaatgtccttgtgttaggcaataccattcaggacatagccatgggaagagtcttcatcactagaacaccaaaagcaatggctacaaaaaccaaaatttacaaatgggatctaactaaacttaagagtatctgcagcgcaaaagaaactattatcagagtgaacaggcaacccacagaatgggagaacattgttgcaatctatccatctgacaaagggctaatatgcagaatctacaaagaacaaatttacaagaaaaaaaaaccatcaaaaagtgagcaaagggtatgaacagacacttaccaaagaagacatttatacagccaacgaacatgtgaagcaaagcacatcatcactggtcattagagaaatggaaatcaaaaccacaatgagatacaatctcagaccacttagaatggtcatcgttaaaaaatcaggaaagaacagatgctagagaggatgtggagaaataggaaagcttttacacagttggtgggaatataaattacttcaaccattgtggaagacagtgtgacaattcctcaaggatctgcaaccagaaatatcatttgacccagcaatcccattactgggtatatacccctaaaattataaatcatactaatataaagacacatgcacctgtctgtttattgtggcactgttcacaacagcaaagacttggaaccaacccaaatgcccaccaatgatagactggataaagaaaatgtggcatatatacaccacgaaatactatgcagccataaaaagggatgaattcacgtcatttgctgggacatgaacgaagctggaaaccatcattttcagctaactaacagaagaacagaaaaccaaacaccacatgttctcattcataactgggagttgaacaatgggaacacatggacacaggaaggggaacatcacacactagggcctgtcagggtggggggctaggagagggatggcattaggagaaataactaatgtagatcatgggttgatggatgcagcaagccaccatggcatgtgtatacctatgtaacctgcatgttctgcacatgtaccccagaacttaaagtacaattaaaaaaaaaagaaatttgcttttaattaagcttttaatcatagaacttgtgaagaaaatccttttgaatcttttattaccacatcatagctgggacaaactgctgacgctttaaaagtaacacaaatatcaaacaggaagaactagacttaggaaccaaactcaggtttctgtagtgaacagggcacaatcttcacattgggtcaccaccactactccttcagtttagccttgactagcaaaagggtggccttgttatgtagatgagaccacttatgtaaaaaaaaaaaagttttaaaaaataatttctgctaactggaatgttttttgttgttgtttatttgtttgtttgtttgtttgcagccataggagttttagccaattcagagggcttgctccccacaatttggaaaattcctttggatttgaccaagtcaggaagagaagggagaaaagtgaaacaacaacaataaagccccaagcataaacaaacaaaaagagttaagcaaaacaacaaatgcacaattcatatgattactgagtgttctaatggtaaggagaaactaaaagcagaaattaaaagcagctggtgagtaatcttaaattttagtcattaaggaaaaattttaagacaaaactctaattcagctacttacctggaaacaaggctcaggctggtgatcgttctctgccatgttagaagctggaaacaacttacactcaccttccctgtcagaagcaagctgaaactcaggaaaggaggtgcctgctctccatcaccacagaagcaggaaaacttgccttccttgttggaaatgagtaaaacttcagaaaaggagttgtacagaaaaatcaaacttagatctcaaccagattttgggagatcagggactctttgcaggggagaagctccacaacctcagcaaattatcctgttggtttgggcaataaagatagcccaggttggtatcaatcaataatgagatttatcaaaggtcaggaccacctttgtaatgaccttctctgtctttttttatctttattggtatatacgttttgtcgaaactgggagtgtaacacctgatttcttctgttttccatttgcttgaaagatttttcaccattccttcattttgagcctatgtatggcactgcatgtgagatgggtttcttggagacagcatactcaaatgggtcttggttctttatccagcttgccccctgtgtctttcaatcggagcatttagcccatttccatttaaggttagtaatggtatgtgtggattagatcctgtcgtcatgctgtcagctagttattttgcagacttgtgtatgtggttggtttttagcattactggtctgtgtacttcggtgcatttttgtagtggctggtgatggtcttttctttccatatttagtgcctcattcaggagctcttgtaaggtagatctggtgataatgaattctctcagcatttgcttgtctgaaaaggatcttgtttctccttcacttatgatgcttaattttgctggacatgaaattctgggttgaaatttctttttcttttaaccatttataataacaccatgttattatatggtatatctgtctctgccatactacgtgaaatttcttttctttaagaagttgaatatcttttctggcttgtagggtttcagctgagaagtctgctaagtctgatggaattccctttgcaggtgacgttgcctttctccctagctgcctttaacattatttctttcattttgaccttggagaatctgatgattatatgtcttggggatgatcttctcgcggcttatcttactgaggttctctggatttcctgaattggaatgttggcctgtctggataggttggggatattctcatgaatgatattctgaagtatgttttccaagttggttccattctcctcatctctttcacgtacactaatcagtcatagatttggtcgtttatataatctcatatttcttggatgttttgttcattcattttccttcttttttcccccattcttgtctgcctgttttatttcagaaagccagttttcaagctctgggattctttcctctgcttggtctattctgctgggtggtcttgcacatgagatggagctggtttgacctcagccctccttagtctgcttgcctctcccaggaccccagcctggccacacctgcttacagggcaatctcaggtgcccacacacactacaataattttcataatgcaatcacacataatcactatgtgactgcattatgaaaattcttgtagtgtgcttttcagctctattaggtcggttgtgtcttctttatacttgctattttgtctgttagctcctacaatgtgttacaatgatttttagctcacttgtattgcatgacaacatacgtctttcactcagtgaactttgttcctacgcatatcctgaaccctgcttgtatcattccagacatctcagcctcagcccagttctgaacacttgctggagagttgatacagtcatttggaggaaagaaagcatgctgacttttggagttttcagtgttctcgcacagattctttctcatctttatgggcttatccaccttccatctttgaggttgctgaccttcggacagggtatttttgttttattgtatttgatgatcttgagggtttcattgtgggataaggtggattcaaccaactggctttgtttttggaggattttaggggggccaatgtgcagcttccaattcctggactgtgtgctttaactctggggaacttgtcttgggtcccaactttgttctctggctcttggaggtttggagtccactgcactgaggggacaaaagtgtggcaactgtggcagaatgctagtggatgcaaaagtccctgcctccctgcgggcgttcacccagtggtggaggcaagacagctggggtgtgggccaggggtcccctgctgtgtgtgtgttgcactggaggtagtgttggttcagggtgggctgctggccagtacaggccatggtgccttctctgtgcccctcaaagcaacagtggtcactcagggtataagaaggtccctttttctctgcacagcattagctcaagggttaggtgctggcaggggtggggttcttggttctgtgcccaccaaggctctgtcttcaatggcagttggtgtgggttggggtgtgtcctgcactcccctgtgctgtcagggcaagtacagcaaaacccacatgtggaaacacacacagcaaagtgatgtaggaagtttccatataaagggctgcagtatggagaggtaatgtgcaggctggtgcgtggctgttggggccaccttgctgcagctctccactgatcaggtacagtccactagcacggaagctatgctgtgggcatccgagagtgccctgtatgcagatgtggccaggctggggtcctgggagaggcaagcagacaaaggagtgctgatatcagaccagccccatctcatgtgcaagactgcccagcagagatcaggtctcagaggagaactctctcaaaagtgaacccccggcacagcatagctgctttacacaaacatggtcaggcttcttttttaagcaagtcccctttttgaggaggggaactctgggacctggtctctgctgggcaatcctgaacatgagatggggctgatctgaacttagcattcctaaagtgctgggataaagtgtctcacaagggcacgtggagcctagagagatagctgtccctgccctctgggctccacatcacctgacttgctgctccaccactctgcttgtctcctgggtgctccatcccatagagatgtgagttagcaatcacttagcgtaatcagcccaggatggagggtctgtgttctgaggccaagccagtgttccctctctggtgatgagcagtggggggtgtgtggtacccgtgggagatggactggcttgttcattgggtcaaccgcagcttattggaggtgtcaatatggcacttagggtctttgctcccttgatattctgagggtagcaagggcagtttcactgcggaggcaatgacagagagaatttcgtttgctcctggaagctctgtccagggaattgctgagttgctactggctggatagttccaatggtggactggctggagacccaggtcagtaggacctgcccatcaagtagactgtctggccacttttctgtcaggctgctgtggtatgctgggggtcccctccagtccctaactgccttgtattttccagggaagatgatagcctgccccttcctctgggagctctgtgccactgaggtacgaacttgttgccagtatgaacgcacctataagatgtgactggagacaagttgagaagtcttatctagtcaggaggaacaaaaacaggcactgagttaaaaaaaaaaaagtctgggcacgtttttctagagcagctgtgctatgctgggtgttcacttccgctcctggttgcctcagacactctgaagccctaatgctgaaatggctgagttgccccaacagcaaagacaacagtctggtcctccccctgggagctctgactcagggaggcctgaaacctctgtcggccagagaacagcagtgaaggcagctggagaccttggttgaaaggcttcacctgctgattagaaatgtggtcggggactgacttaaacaagagtctggccacgttttcgtagtgtggccgtgctccgctgaggttcctcttccaccccttgtcaccttgggctttccaaagcccgcaaaccagaacggctagtcacccaaacagcaaaggtggtggcctacccctctctctgggagctctgtcccatgaacacttcaaatttctattggccaaggaatgctggtggcggtagctggaggccccatttgggaggtcctgtacaatgatgtgcaacagggtcgggggcctgcttacagaagcattctggccatgatttggtaaagcagctatgctgtgctgtgggatctcttctgccccttgtcggtttatactctccaaagccctcaggctggaatgactaagttgcctgaacaggaaagatggcggcctgccccatctattctctcagagttcatcttgtttgatggagtttaatttttagcctgttaattttactgtctacattagacttgttcggaaagaatctgctatattttaggttagatatatgagaattcattgtttactgtaaataaacctgttcatgtcttgttctctggaaagaaatctctttcaactatctgacgttggtcacagtcatgtagagcagtagccagtctataatgacataattgaatttccatttccagtgttttgtttttgggtcttacattgtacagttcagaaatgagcattttattcccaattgtcaaaatgctaagctgtccactgtactgaaatactgtttttgttaatgcttcgtcattcaattttttttaaggtgaacacttttatccaacttttctcaagtcagagtacaggtaagccctggctgcctcgagccactctcagggagaccaaaacccttcatacattccaagttgggatacaaaaaagtggggccatgaaggctagtcattcaaaataaaacaaaatttaaaagtattaaggcaaagatttaaaaaaatttgcattacgtaatttacacaaaagcaatgctatcgcctaccatgtgtgaactcgggagaggactgggccattctccttagagagaagtagggtggcttttaggagggcaaggggcttcctgaaacagtgcatctcacaatatttggaatgactattgaaaagaagaacattgtacaatcaaagtccttggcaacattgtagaactagcgggtgctgacccctgagccacagccacagttctgggtttggggtttggtaaaaccaccccaaggacagagttctggggccaggttttggaggaaccaaggcgcctctcagggatggtgtgtcactcctgcttgccatgaaatgtgcacacaggctgtccccctgcccatcccatcctgctggacaggatggaggaactgagggaacaggcagggtggacagctggaattcagggagaggcaggtgcatgctgggaggtcaggacctgtgagggctgtgggggcatcaggtggagttggctccatgtgcaccctcagtgcacagggcaggtctcaggccaggctccctggaccccggctgggtgatgtggtcactccctgggggactgctctcagaccctggccaccctccctgggcagcgccgtcccatcccagaactggactttctgagtcctaaaacaggacagtgctgcccaggcctgacagactgggaggacctgtgaagtcctccatccctagaccagcctcccaacagcagggacagtctcctacctttaccttcagggcactgactgatacatctcattctaaggcaaccaaggcagacctgaggacctgtgccaggctgggagccagtcctctccctaaatgggccttagggaagcctcatgcctgtcccaatgcactgcaagtttcagcccaggagacacatagggaagtgaggacggggcctccccactggctgaccctggaaaagcgggaccagggagaagagggagtgcagggctggcaggggatgctccaggcccatggagagctcaggctgcaccaaggggcttcccctcctgggctggaggctgtgccctctgcagtatctgaggaagtccagtcctgagatgggacagtgctacccagagtgggtggccagcacctgacaacagtctcccagcaagtgaccacatcacccagccaaggtccagggagcctgggccaagacctgcccagtgcgctgagggtgcacctggagcccacaccacctgacgcccccacaaccctcatagggtctgacctcccagcatgcacctgcctctccctgaaaccaagctgcccaccctgcctgttccctggcctcctccatcctgtgcagaccatagactgtgactatctctcccaccactctggcccttcctttacctttgtcctgtcagaatctctgagcaagatctcctaggtccatccaaacacctgctttgtccacttttgactgggccattgaacaccactgggccaccccagctgtccacaggttcctcgataacatgcatttcccctgacatctcccagcagtactcagcagcccccactgaccaggtccctggtgacaagttccagcatatcacttcctccctgaccacaccctcactgattagagccccatcaccaggcctcactaactagattcccgctgccaggcccacaatgtccaggactccactgacgaggaccttactgacaaggcctcactgacgaggtccttactgacaaggcctcactgatcaggttccaccgatcatgaccccattgtctggtcccacagacgaagccccactgaccaggcctgcagggaataggcagccagtgaccaggcccctgctaaccaggactgaggtgacaagatgcccctgactggggccctaatgactacgccccactgaacaggcacgcactgctcagatccccgctgaccaggtcaccccgtagaccagtgctacaaaagccaccaatgatcaagtcctctctgaccaggcccccactgattaagttccacggaccagcctgccctgaccagggccccactgacaagcgtctctgctgactaggtcccaaggtctccactgaccaagtcccacagcccaggttggcactgaccagacaccaaacatttgtctaccactatcaacccactcaacaagacatgcactactagatccctctaatgagacccgctctaagcagacccctgctgaccaccccccactaaataggcctcactgacaagtcccaactgactaggtcccctgagcaggcccacactgatcaggcccctcctaaccatatcagaagaccaagaggcaatgagatgtttcatatggcaggagtaggagaaagacagagaggggaaagaggtgtgacatcctgttagacaaccagatcacatgagaactcactatcaggagatcagcatcaagaagactaaccaatggtgaaggattctccaaccacaccactggccactgcttccaggcagaagcctcctgcagaggcagaacctcttatgaaacttccactatggcagtgcagaaggaaaatataggctttgagcccccacacaagaggccatgatcctccagactccagattaataagcccaccaacagctcacattctgagtatggaaaagctacaggcactcaacaccaacccagcccatgagagcagccatgggggctacaccctgcaaagccacaggtgcactctcctagtagaggtttcccatgagcctctgcctctgcagcaggttgctcccaccctcccaccaccctactgacaacctactcctccccacactatccctccttttccttccaccccaaccccctcccatccaagattaagtcacctcccacctggcccacctccaacattaaggatgacacgtgagttttatagggacacacagccaacccatattattctgaccctgattccccagaacctcatgtccttctcacagagcaaaacacaatcatgccttttcaaaagtttccaaaagtcttaactcattccgaatgtaaaaatttcaaaatctcatctgagacaaggttacagttccttctgccaatgagtccctgaatttaaaagggatttcttttccttcaaggtagaacaggcattgggtaaggtttctcaatccaaagggaagaagttgctcagaaaaataacacaaatgcaagtccaaaacccagcaggacagtattcactcaatctcacagctccaaaatcatcaagagaactcactgtcgtgcggacagcattaaggagatagtgtttactcatttgtgaagaatctgccccccaccttcacctttcactcccacccacaaaataatctctcccattctccccacacccctacctccaacacccactcttctccatgattaaatcacctcccaccaggtcccacctttaacattccccactacaattccacatgagcattggtagggacacagaatcaaatcatattattctggctcttgctccccaaatcttgtatccttgtcacactgcaaaatacactgatgacttctctactgtcccccaatgacttaactcattccagcatttactgaaatgtacaaggacttacagaccccatgcaagtcaaaaacccagcaggccagtcattgaatcctgcagctccaaatcatcttttctgaatctacatctcacatctagagcacaggtgtgtgatgcctgggcttccaaggccttgggcagctctgcgcctgtggctgtgcagggtctataccccacagctgccctcatgggctgggctgatgttgagtgcctgtagcatttccatactaagggtgccagctgttggtgagtctatgaatctggagtctggagaatggtgcctccatatttagggactccagccctaaattctccttctgtactgccctagtaaaagtttcccatgaggctctgcctcttggaaaagattctgtgtgaacacccagtttttccgtacatactctggagtctagacaaaggcttgcaagcgtctagttttgtgctgtgtgcagctgctggcttaacactatgtggaagccaccaagccttgaagcttgcacccctgaagcagtgatgcaaggtgtacctgtgcatctttcagccaaggctggagctggagcttcaggaatgcagccagcagtgtcctgaggttggacatagcagcggggccatggggctggagaaggaaaccattcttttctcccaggcctcagggcctgtgatagcaagggctgctgcaaaagtctctgaaatgccttcaagacctttttaacattgtattggctattagcactgaactcctttttatgcacatttctgaagacttttttaactttcccactgataatcagcttttctttttggccacttggccaggcttcaaattatccaaacttttaagctctccttctcatttaaatacaagtttcaccttgaggtcatttctttggtcacatataggaccacaggctgttcgacacagacaggaaacctcttaagctttgctgcctaaaatttcattccaccaaatacactctaaattatcaccctgatgttcaaaatttcacaggtctccaggttaggggcatcatgcagcaacattctttgctaaggaaaaaacaaaagtgaccttgactcctgttcccagcaagctcctcattttcatgtgagacattctaagcctggtgatcactgtccatccttctgtcacctttttaattataactatttaacaagtctctacactgttccacacttttcctcatcttcctgtcttcttccaagacctccaaactctccaacctctggccattacacacttctcaacctgcttctacattttcagctacgtttgtcacagcctggcaatgtggtaaaagaagaaaagtccatttcaggagaaaaattaatgcaggcttcagacatttgcctgaaaagaagctgagtgctgattgccaagagaataggaaaaaggccttgaaggcatttcatagttccactttatagcattatttttctgtataatcagaaagaaaagaggttgaactggctcatggttctacaagctttaaataaatcatagaggcttctgcttctgggaggactcaggaagcctcccaatcataccagaagaccaagcagcaatgggatgttttatatggcagaagtagaaacaaaacagagaggaaaaaggtgccacacgttgtataaccctgttatacaaccagatttcctgagaactcactatcacaaggtcagtatcaagaagatgttgcttaaccattggtgaaagttctgccccctaccacccacacccctcactgtttccaggcagaagcctgaggaagaggcagagccactaggaaaacctctaatagggcagagcagaaaaagtatatgggcttggaggccccacacaggaggttaccatcctcagaccccagattcatagactcaccaacagcttgcactctcagtatggaaaagctacaggcactcaagcaacagcccagcctatgagggcagccatgggggctacaccctgcaaagccataggtgccctgccctggtggaggttttccttgaggctttgcctctgcagcaggctactcccccttactactgcccatgaaactctcaccaccctactgccagcctactcctccccatcctacgcatttgttttcccttccaccgctaccaacctcccctttgtgattaaatcacctcccaccaggcccaacctataactgtcaggaatacaattccccatgagtttttgtagggaaacacagccaaaccatattatcctgaccctgacacccccacatctcatgtccttctcacacagaaaaatacaaacatgccttttcaaaagtttcaaaaagtcttaactcattccagcagtaactcaaatgtagtaagttcaagtctcatccaagacaaggctgcaatcccttctgcctatgactccctgaatgtaaaagacaattcttttctttcaagttacaatgatggcacaggcattgggtaggctttcttaaaccaaagggaaggttatcccagaaaaataacacaaatgggacacaggcccaatccgactccaaaacccagcaggacagcattcatttatcacgagaactcactatcacacagactgcattaaggagatagtatttaaccatttgtgaaggatctgccacccatccccatgtttcaccctcacccacaccatgaacctccattctcccacatcccccttccaacccccattctctaccatgattaaatcaccttctacgaagccccacacttaacattccccattataattccacatgagttttggtagggacacagagccaaatcgtattattctccctttggccccccaatctcacatccttctcatactgcaaaatacaatgatgcattctctacagtcccccaatgtctgaactcattccagcatttactcaaatgtccatttgtgaaggatctaccccctacccctgcctttcacccccaaccccaccacaatcgcccccaaccctccccaccccttaatccccccaaccctccccacccccaaccatctaacctccacccttcaccatgattaactcaccttccaccagcccccacctttaacatttcccattaaaattctacatgagttttggtagagacacagagccaaaacatattattctgtccctggtcccccaaagttcatgtctttctcacattgcaaaatgcaatgaggccttccctagagtcccccaaatcttaactcatcccagcatttactcaaatgtccaaaggccaaagtctcctctgagacaaggctgccatattttctgccctgagcctctgaaatacaaagcaagttaaccacttccaagttacaatgattgtacaggcattgggtaagcattccaagccaaaaagtagaaatttcccagaaagaagcacaaaacacagatgggacttacaaaccccctgcaagtcaaaaacccagcaggccaggcattccatcatacagctccaaatcatctttttggaatctatgtccacatccagagcacagggttttgtgatggctgggatcccaaggccttgggcagctctgcacatgtggcattgcagaatcttccccctacagctgccctcattggctaggctggtgttgagtgcctgtagcttttcaacactaagggtgcaagcagctggtgggtctatgatactggggtctggaaaatggtgcctccctgtatggggactccaaccctatactttccttttctactgcccgagtagaggtttaccatgaggctctccctcttggaaaagcttctggttagacactcaggatttctgatatatcctctggagtccagaccaaggctctgaagcttctagtcctgtgctttatgcacctgctggcttaacactatgtagaagccaccaaggcttggagcttgcatcctctgaaacagtgacgcaagctgtacctgtgcatctttcatccatggctggagctggaaaaggagctgcagggatgcaggcagcagtgtcctgaggctgcacacagcagtggagccatggggctgggccaggaaactattcttttctcctaaaccccagggccagtgacagcaagggctgctacaaaggtctctgaaacgccttcaaggcctttttcccattgtcttgaattattagcacggggctcctttttatgcaaatatccgaaggcttcttgattttccccctgaaagtcagcttttctttttgaccatttgtccagattacaaattttccaaatgttgaagctctgcttctcatttaaatataagttccaacttatggtaatttctttcatcacacataggagcacaggcttttcgacgtaggccggacaactcttcagctttgctgcttagaagttcattccaccagatacaccctaaatcatcaccctaaagttcagtttcacagatctccagggaatggtcactgtgtagccaattactttgctaaggcaaaagaaaaaacccttggctccttttcccagtaagtttctcattttcatctgagaccttacaagcctggccttcagtgtccatccttctgtcagccttttaatcataactatttaacaagtctctgcaatggtccaaactttccctcatcttgttatcttcttccaagctctccaaactctctaacctctggccattacccaatttggaacctgcttctacactgtcatctatctttgttgcagcctggcgatatggtaaaagaagaaaagtctattatcaggggaaacatcaagatggcttccaatatttgcattgaaaaaagctcagcgctaatagccaagagaatgggggaagcgcctagaagtcatttcataacttcacttcacagcattaattttctgtatctacataaagaaaagaggtctaattgactcacagttcttcaggctgtaaagaaagcatagtggtttctgcttgtaggaggactcagaaagcctcccaattataccagaaggccaagcggcaatgaaatatttcatatggcaggagtagaagcaagacagagagaggaaagaggtgagacatcctgttatacaactatatctcatgagagctcactatcaggagatcagcatcaagaaaattgtgcttaactgttggtgaaggatccgcccacctccccatatccaccacccactgtttccaagcagaagcctgaggcagagacagatccccttgaaaaacctctactagggcagtacagaaggaaaatatgggcttggagcccccatgccaccatcctccagacccaagagtcatggacccaccaacagctcacacccccagtatggaaaagcttcaggtactcaacaccagcccagcccatgagagcagcagcaggtgctaaaccctgcaaagccacaggtgcaaaaccacaggtgcactgccttagtagaggttttccatgagcctctgcctctgtggcaggctactcccttcctgctacacaccaccctacagccagcctactcctccccaccttacccacctgtttttacttccaaccccacccctctcccatccatgaataaatcacctctcaccagtccccacctgcaacattcgggattacaattacatgtgagtttaggtagggacacacagctaaaccatattattctgaccctgatcccccaaatatcatatccttctcacagagtaaaatacaatcatgccttttcaaaagttgccaaaagtcttaagtcatttcagcattaactcgaatgtaaaaagttccacgtctcacctgagaaaaggctacagtcccttttgcatacaagtccctgaatttaaaagggagttcttttctttcaaggtacaatgatggtacaggcattgggtaagttttctccatccaaagggtagaggtttgccaggaaaataacacaaatgggatcacagggccaatgcaagtccaaaacccaggagaccagtatccattaaatctcacagctccaaaaccatcacgagaactcaccatcatgaggaaaggattaaggagatggtgtttaactatttgtgagggatcatccccccacccccacttttcacccctcacccccagcataatccacccatcctccccagtctccaccttccaacacccagtgccctccatgattaaatcaccttccacctggccccaattttaacatttctgattacaattccacatgagtttccatagcgacacacagccgaatcttattattctgtccctgcctccccaaatctcatgtccttctcattttgcaaaatacagtgatgccttacttacaattccccaagccactatgctttttttttacagcctgcagaaccatcagccgattaaacccctttttgttatgatcatacagaaaattagtactgtgaagtgaagctatgaaatgccttcaatgacttttccccatcgtcttggctaagacctccaaggtcttaactcattccagcatttacttcaatatctgaagcccaaagtctcatctgagacaaagatgcagtcccttctgttcctgagcctctgaaatacaaagcaagttaactatttccaaggtatgattgtccaggcattgagtaagaattcccaccctaaaggaagatttttgccagagagaacaacgaaacacaaatgggacttacaggtcccaggaaaatccaaaacccagaaggccagttactcaaacttacagctccaaagtcatccttttttaatccttgtcccacatccagggcacaagggcatgagggctggactcccaaggccttgggctggtctgcacctgtggctttgtagttttcagtccccacagctgccctcatgggctgtgctggtgttgagtgcctgtagtttttacccacagagtgtacaaagctcttggtgggtctatgaatctggggtctgcatatggtggcctccagtgtgggggctccaaccccctattttccttctgcactgccctagtagaggtttcccaggaggctctgcttttttggcagccttctgtctggacacccaggcattttcatacatcttccaaaatctatatgaaggctctgaagcctctgggctagtgctctatggacttgctggcttaagactatgtggaagccgtgaagccttatagcttgtaccctctgaagcagtgatgcaatctgtaccagtgcatctttcagccaaggtcggagcaggagctgcggctgctgggatgcaggcagcagtgtcctgaggctgcacacagcagcagggccatggggctggccccagaaaccattcttctctcctaggccccagggtctgtgacaccaagggctgctgcaaccatctctgaaatgcctccaaggctttttccccccattgtcttggctattagcactggcctccattttatgcaaatttctggagccttcatgaattttccccctgaaaatcagcttttctttttgaccacttggccaggctgcaaatggttctaaacttttgagctctgcttgtcatttaaatataaattccaacttgaggtcatttcctcagtcacacataaccttggtcacacaagaacacgggctgtttgatgcagacaggatcccccttgtgctatgctgcctagaagttcattccaccagatatgcactaaatcatcaccctcaagttcaaagtttcacagatctcgagggcaaggtcgcgctgcagccatgttctttgctacagcaaaacataagtaaccttggctcctgttcccagtaatttcctcattttcatctgagaccttgtaagcctggccttcactgtccatccttctgccagccttttaatcacaactattcaacaagtgcctacgatggtccaaaatttctttcatcttcctgtcttctttcaagctctccaaactctccaacctctggctgttacccacttctgaacctgctttacattttcagctatctttgttgcagcctgacaatgtagaagaaaaagaagtccattttcagggggaaacttcaagaagtcttcaaatatttgcattaaaaagaagtccagtgctaatagccaagacgatggggaaatgtcattgaagatatttcatagctccacttcgcagtactttattttctgtatgatcataatgaaaaggggtttaattggctcatggttctgcaggctgtaaagaaagcatagtggcttctgcttctgggaggactcagcaagactcccaatcataccaacaggaaaacagcaatgaaatatttcatacggcaggagtaggagcaaggctgagagaggaaagaggtgccacaccgttatataatcagatctcatgagaactcactatcactatgtcagcatcaagaagatggtgcttaaccattggtgaaggatccgccccccaacacagctccacctcctagtgttccagacagaagcctgctgcagaggcagaggctcttgggaatcctgtactatggcagtgcagaaggaaaataagggctttgactgactatgcaggaggccaccatcctcgagaccccagattcatagacctaccaacagttcacaccctcagtatggaaaagtgataggctctcaacaccagcccagcccatgagagcagccatgggggctaaagcctgcaaagccacaggtgcactgccctggtagaagttttccatgagcctcggcctctgcagcaggctactcccccttcctactatccatcaccctcccacggccctacagccagcctactcttccccaccctacccaccccattttttcttccacccctacccctcccatccatgattaaataatctcccaccaggccccatctccaaaatttgggattacaattccacatgagtttttccaggggcacacagccaaatcatattatgctgaccttgaccccccaaatatcatatccttttcacagaataaaatacaatcatgccttttcaaaggtttccaaaaggcttaactccttcctgcattaactcaaatgtaaaaagttttaagtcttatctgagacaaggctgcagtctcttctgcctatgagtccctgaagttaaaagggtgtttgtttctttcaaggtacaatgatggtacaggtactgggtaaactttctcaatccaaagggaagaaatttccaagaaaaataacacaaatgggaccacaggcccaatggacatccaaaatccagtacgtcagtgttcattcaatctcacagctccaaaatcatgaagagaactcactatcagaaggacagcattaaggagatggtgtttaaccatttgtgaaggatccacccccacccctgcctttcacccccaaccccaccacaatcccctccaaccctccccacccccgattccctccaaccctctccaccccagaatcccccccaccctcccggtgcccccaaccatccaacctccactctccaccatgattaaatcaccttccatcagcccccacctttaacattttgcattaacattccacatgagctttggtagagacagagagccaaaacctattattctatctctggtcccccaaagttcatgtctttctcacattgcaaaatgtaatgatgtcttccctagagtctctcaaatcttaactcattccagcatttactcaaatgcacaaagcccagagtcttatctgagacaagtctacagtccctcctgcccatgagccagtgaattgtaaagcaagtttactacttccaaggtacaatgattgtacaggcagtgggtgactcacaggatacataagtgtccaaaacccagcaggccagtcacttaatgctacagctccaaaatcaccatttttgaatccttgtcccatatccatagcacagggctgtgagggctgagctcccaaggccttgggcagatctgcacctgtggctttgcagcgttcagcttccgcggatgtctctcatggacagggctgttgttgagtgcccatagcttttccacactgagggtgcaagctgtttatgggtccatgaatctggggtttagagaatgatgcctccctgtgtgggggcttcaaccctataggtcccttctttgctcctctagtagaggttccccatgaagctctgcctcttggaaaagcttcttcctgaacatccaggattttctgtacatcttctggagtctagacgggagtttccaatcctctaatctctttctctgtgcacctactggcttaacactatatggaaaccatcaagactttgaggcacctctgaagcaatgacccaagctgtacctgtgcatctttcagccatggctggtgctggagctgcacggatgccgacagcagtgtcctgcggttgagcacagcagcagagccatgggactggcctaggaaaccattcttttctcctaggccccagggcctgtgacagcaagggctgctgcagacatctctaaaatgctttcaaggccggtttcccactgtcttggcgttttgcactgggttcctttttatacaaataccctaagccttcttgaattttccccctcaaaatcggcttttctttttgaccacttagccaggctccacattttccaaactttagatctccacttgaagttccaacttgaagtcacttcttaggtcacccataagaacacaagctgttcaatgtaggcaggacacctcttgtgctatgctgcctagaagttcatttcaccagatacatcctaaatcatcacccccaagttcatagtttcacagatctccagggcagggtccccatgcagccagcttctttgctaaggccaatcaaatgtaatcttgtctcttgttcataggaaattcctcattttcatctgagaacttttaggtctggacttcagtgtttacacttttgtcagccttcctatcacaagtatttaacaattctctatagtggtccaatattttcctcatcttgctgtcttctaagctttcccaactcttctgacctctgtcttttacccacttctgaacctggttctacattgtcagctatctttatcacagcctggcaatgtggtaaaacagaaaagtccattttcagggggaaagttcatgaaggattcagatatttgcatgaaaagaagctgagtgctggttgccaagacaaaggggaaagggccttgaaggcatttcatggctccacttcatagtactaattttctgcatgatcataaagaaaagaggtttaattggctcacggtccagcaggctgtaaaggaagcacagtggcttctgcttctgggaggatcagatcaggaagccttccaatcataccagaaggccaaggggcaatgagatgtttcaaatggcaggggtagaagaaagactgagagaggaaagaggtgccaccccctgttatataaccagatctcatgagaacacactatcatgaagagagcatcaagaagacgttgcctaaccattggtgaaggatctgcctcccacccccacctcccactgtttccaggcagaagcctgctgcagatgaagcattcttgggaaacctctactagggcagtgcagaaggaaaatatggacttggagcccccatgcagggggccaccaccctccagaccccagatacatagacccaccaacagcttgcaccctccgtgtggaaaagctacaggcactcaacactagtccagtccatgagagcagccattggggctcaaacctgcaaagccacaggtgcgcttccctagtagggattttccatgagactctgcctctgcagcaggctactaccccttcctactacccaccaccctcccaccaccgtacagtcagtctactccctcgcaccctacccacccctttttcccttccacatccacccccacccatccatgattaaatcactccctcccactccctgtcataatctaatccctccaaacccttccaatctttgtttgctacccactactgagcctgcttctactttttcagaaatctgtatagcaggttggctatgtagcaataacaaaaatcccatttaaggggaacattcaagaagatttcagaaatttgcatataaagaagccctgtgctaatagccaaaacaaagggaaaaaggccttgaaggcatttcacagctcctctctgcagttctacttttctgtattattgtaaataaaagaggtgtaattgactcatggttctgcaagctgtgaaggaagtatagtgtcttctgtttctgtgaggaatcaggaagcctcctcattatatcagaaagccaagggacaatgagatgtctcctaaagcaggagcaggaggatgagatctgttaaacaaccagatctcatggaaactcactcattatcaggaggatagcatcaaggtgatggttctttatcattcgtgaagtatctacctgcaccattttatgactaaatctttttccacctagaccttgcctgtaacattacaaaatataattccacatgagttttggtagggacatagacaaaaaccgtattattctgtccttgacccgatgaatctcatgtccttctcacattgcaaaatacaaacatgccttgccagcagtctcccaaagtcttaactcatttcaggattaactcaaagttacaaagtccaaagtctcatctgggtcaaggctacagtctcttttgcctatgagtctctgaaataaaaagcaggcattgtgtaagctttccatttccaaaaggaagacattttccagaaagcttcttatttctctctgagacctcctcagcctggccttcactgtccatgtttctgtcaggatttttgtcacaaccattgaaccagactctaagatggtccaaaagttttctcatctgtcttcttttgagccctccaaactcttccaacctccatccattacctggttccaaagctgcttccacatttccaggtatctttatagcaaagctccagtcctcatttgccatttcctgtatgatttattttgaaaaagaggtttaattggctcatggttctaagcacagtgcttctgcttctaggcctcagaaatctttcaataatcatggaaggcaaagaaagaatcaattgtctcacatggcaaggggaaaacacggagagtggggaggtgatatagagatttcagtgactacatctcatgagaagtcactcattattgtgaggatggtacaaggggatggtgctgaaccattcatgagaaatttgccttcataattcaatcacattataccaggatccaccttccacattaggaaatataattcaacatgagattcggtggggacacatattcaaattgcatcatcaatctttgaatataaagacatccacagcaggttttatccagccaacttctttgagactctttatagagtttgaagtctagagcatatacactaaaatattcatacttcaaaaagcaataaagtggtattatcatttttccaaaagttacagcagtagtttaggcattcatagtatgatttagttcacgattgctactgtttctattctatcaccatattaactgtttcctatacaattctgtattcaactggatttcagttgagcacaaaaccatccttgtactagctctttgctagtgttattattctgctgtagaaagtatccttgaactggaaaccgtccacgatcgagtattgagtcattcaacactatcaattcctgggtgactttttgaaaaagtagtatctcttgttgcaagaaatgctgcatctgtgagtccatgtctctcactggaattggatggaagtggtgaatttcagccaaagtggccaaagaaatcctgttcctgtgattctgacgtcatcagcctctgcaccttcttctgcacctgtgtcttcccttctgccacatgttgtctgctctccatgactttggtaagagcttccttgtgtatgtggatgatgtccagggtgttggtctggtgtccctgagacagcactaacaggtccatggctgggtccaggtccttcctggactgactggcaaagagctcactgacagagtggaaggcatctatactgaagtggatggcctggtccagctccaaggcctggctgaggctgaagaagaactgtcaggcttctgatgctctttctcaaagcctgccaccactcattggctgtgaagttgagctgagtgccctgttgtccatcttcttggtgaagcacttgaagccgtcaatcttgctctcccactcctaaaagttgagtgtcacactgggggtgggctcagggccaggaagaatctggcactcaccatctcatccttctcagccttcctcttgccctgtctccaggctatctcttcagtgctggtggggcacatcaggaagtgacaaacaatgtggcactgcacctgcatccagaagctggctgtgtggttcatctacaagattgggccctttctgcacttgaacatagatcctacttcaaaatagatgcttccacactgtcagtgagctctttgcccatcagcccaggcaggatctggacccagtcatggacctgttagtgctgtctcagggacaccaggccaacattctggacatcatccacatacacaaggaagctcttaccagagtcctcctcaagatggcctgtggtctgcctcttggcacccgagaagcccacagtgctgtagaagccccgatgcttggactggagccccaaaggcggcacacaccccagttctgagcctgctgctcatttcctctctgtggctccatttgcagcacatttgttgcactgaggcctgtgcatgccaggcaaagccaagctggctcaaagagcaaccacccacctctgcaatggtgtgccaggagccagtggaccagccaccaacgtcactccctgccagtcagggtaaatcagttattctgccctggaggtggagccccagtgccatctgcttttcctcaggcctccactccatcagctgtcaggtggtggtcactcagactgtgggaaactggccatccctatttccttgagtgggtgaggttggtgactgctccacctgctcctggcacacccttgcagaggtggctggttgctctttgagccagcttggccttgcctggcatgcacaggccccaggtactgagaagctgctccgagtaaggttgtcttgggccaaattctaagtctggccagggccacagaaggccgagtcccctgggtggtaatcctggctgctgcaggggggcccatggtgcccctcccctcccagggctcaggatgaggtccgactgggacaggatgctttaggtatggggcttgtgccccaggaggggacctctgtcacacacgttgggtgagaatatgtatggcatgctgctggctgccagggctgttgggatgcacgttcacccttcccttcagggacctcaaagtgaccagcttcccctttatgaatgacttccaaggcccaggagccatttggggctgcagagcagctggctgcatgctgccctggcttcttccatgttgtgctggtcactacctaccaaggggggtcagatgcaggcacaatgtaggacgattgtctctggacctgtgtcttggttatcatggagctagactgggcctggtgacagggccctgatggggttgtcctgtgtggtcacggaggtgatcagaaaagatgcagaatggaattgctgcgaggatgaatgagatgactgtcagcacataacaggcagctggtgagtgttcagggattaccctcagtagctgcccagagaccaaaaccatccacctgatagtgacttttcccaagccaggaggaagagaaaagagcaggtcccactcacctgaatctgatcagtgagctgtgttgagatgtgcctctcatctagaaaatggtccttcacgcagagctactcacagacactgctgtgtgtctctaactgctccacaacacagaggtgatggggactcagcaacagtgacattgtggggtgacacaacccaccaccatgggagtctgcttgggtcaacagggcccagagtcagtgtcctctatcccctgaactgacatgtgtgtatgcaatgtatttgtgtatgcatgtgtgcctgtgtgtgtgtgtgtatgtgtgtgtttgtcttgcttctctggacaggcctagcttctccactcatgggtgcacccaggtcctcatcactgtcaccttagagcattagagcctctataggtgctccccaatctctgccctccccacccatggtggtcctggggatgcagacagaggaggggcactgcataatgctgagagggctggcaccctctctaggtggaacacaggtcatttgtaaagttgtaggtctgccaagcagtattggattcaacacatcttctcaccttctctttccagccaccctccagggtgccccgactcactttccctgcagatggaggcaaggaggctccacagacaacccccctgcctgaggtcacatagtggccagcaggccaggtactgacaaactgcccctgaccaggttcccagtgatgagtgatgagacccctaatgaccactcctccattgaccaggtcccactgatcaagtccccactgaccatgtcttcctaaccaggcccacacttaataggcctcatgggccagaccccactgaccaattttccactgacctggtccccattgacaagacagggttcccactgacaagaccacaatttaccaggttgctgctcaaccgaccccccactgaacaattctccatgaacgagtacccagctgactgagccccctctgaccaggccctcactgaccaggctccaagccactaaggccccacactgaccaggcccgtgatatattgtgtatgccccaccaaccagtttttcattgtttatgttccaacagatcaggccccactaataaagccaccactgactaggtccccccactgaccaggcttccaatgactaggtcaccaggtccccattgatgaggcctttactgaggaggccgccactaaccaggcccctgctgatcaggtcccaaatgaccaggtcctgatgaccaggtcatctctgaccatggtccactgaccaggccccggagcaatggggttcaaagtctcattacaatgtccccctcagctcatagaccctccctccctgcatgtgtgcccagaggtcaggccctgggggtttttttgggacgtggcctttcctccaagacacagggagagacagttggcctcaggctccaggttccgagatccacactcaccccaaaggcactctgggcccgtctcaaaggagaaagtgaggtggcctgacactgcctggacacaccatctaccctattcctgagtgtcagagtgtgaggaagggagggacttttggcagataaggcacgctgtgctgttgggtctctcagggcccttcccacagagccccgatctaaagacacaacacagaggctacaggaagactaatccagaacctctgagacagccagggaccacatgaggactctccccagacaggcagaaggccctttgctagtttcttggtacttcagtggatgtggcagtggttcttctgttggggaccagtgagtacacactggggagggctcacctgtgcttcctcagtggctccacctctgcttctaaaaaaaattactcattccagagctggcgcagagaaaatacaagctgagcttagaacatcttctgccagaaagtaaaaaagtgccgacggagtaatggagacaaatcaaagagacataaagtcagcttggaatgtctactactggcctaatcttggggaattggagcatcagaatcatgagctttccttctcccttatttattggttttatttctccatgtagaacaaagaggagaataagaaaataatcatctggtaactatcatagtaataattgttcaaacacaagtcatccatgaaatgctaaatctagtgggttctgaggagtaaccagatatttacagagcctcaaagtatctccatacaaaatacggttgaactacaaaaagaaaattgtaacattagcatggacaaaccttgcaggtactacttaactctcctaagtaataaaaactgtaaaatgcaaataagccttcgatgacctttactaacctttactaaagtatcaatgatgacttggttgtttaaacagctgacatttgggcaatttgaatatgtcaaactcaataatactggttttcatttgcaagatccacttaaaacttaaggaggccaaaaaacatcatttaaaataccctataaattataatcatacatatgatacaaaaatatcctacttcagtaaacattggaatgttatatatttcatgagaaacaattaaaatgtgtaaatagcccagtaataaagttttataatcttttaaatcatcatagaatttttccttaagactttatggttaaatattctcttcattagatgtggcttacccgtggattctagagaagaaagtagatgggagcaagtgtccaatacagcaacagctggaaagaaaaataaagaattttgttctttacctaaaacacttcagttaactaagtgtgagtttaaaaactaaagacttgagaactttatcagagttaataagtgagaaatatgtatgtacatatacaacacaaaattactatttaataatttacacatggcattaattctaactgtgtttaaatatcagagctttttcagtcttcattcatgtaatcaacagccacatgctaaggtactagaaccagcactggaattacaagatgaagatggcatggtccacctctcaacagtcataagctataacctaaaaaacagacaggcaggaaatgtccatatagagtcatagataccatgacaggtatacagcagggcactactggaacacagagaaaggacatctacccacttttatgtcaatatcatgggctttctggtggaggagataacataggttgatgcctgaaggacaaggaaaagcttcccagatagaggaaagaggcaaaggcaaagagcctgaggtgaggaagagccctgcagagttccactccatccagtttggtgctacagcaaagggcagagtgcaataagtggtgagaaacaaggctgagtaacttggcaagaattacattgacatgggtgtttttatttcatggtgaaaaatttggaacttttcctgagaacaagtgtaagccaatgacacagtaaattagaggagatttaaaatgtcacctgtcaagtgactgcttatgaagggttattgctcagctaagtatttctgaatgagtcttaggtctgttggccttcaatctctaccaaaaccctgagaacttgatgatgcttttgttttctgagaatcgtttcagtgtgctggctgacagttccatgaggatggcaaaacttaagaaagtgtagagccagtgaaaaagagatgcacagacttcttgggaactgtttaagctttggaacatgatgaatttatggtgcataagtacagtcttctctgtgaaagtttttgttttcacatctttcattagatgtgtgtaagaaaaaaaatattgatgtagtatctactaacccaagaatgaaaaggaatgccatttgctatttacactttatttctaaaataaacctaaatttaattaataaattttgtcaacgtacttctctttgtttctctaattatttattctacacagtccagccccatctaaagtaagtaaaaataataataatgtctaaattaaacaagaaacattataatgaaaatcatgtatcacttacaaaatgtggcctttagtatttttagtgactagacataacttgaagtttgcttaaatagaaaaataatcacataaataaaataaaatttctacttattttaagtttagataacagaggatgtatatgtgtaatgcggtttagagtaatctgacaaaaatgcagttaatattgatctattgcatatacatgattttagaaaggtagtgttttattagtacaaaggttaaacaatggccaggcatggtggctcatacctgtaatcccagcacttggggaggccaaagcaagcagatcacaaggtcaggagatcgtgaccatcctgaccaacatggggaaaccccatctctactaaaaatacaaaaattagctgggcgtggtgatgtgcacctgtagtcccagctacttgggatactaaggcaggagaattgcttgaagccaggaggtggaggttgcagtgagccaagactgcaccactgcactccagcctggtgacagagtgagaccctgtctcacaaaaaaaaaaaaaaaaaaaaaaaaaaaaaaagattaagtaactaaagccatcttttgcaatgaatgcattgctttgaaattctcagaaaactctgccctttataaaagtttaatccattttttacttcaataaattttatcttaaaaagaaatttctgttctccacttataggaaacttttctttttttttctagtttgtattctaaattaacgtggtacctctgtaagtttcttccaaaggcatattgagggataccgaggtttgcagtacaattaaacccatcacacaggttgtgagcataggacccaagaagtagtttttcaaccctggcccactctgtccctccccattcttatttcccagtgtctattattcccacctttatgacaatgtgcacccaatatgtagctcccacatgagtgaaaacatgagatatttggtttctgtttctgcgttggtttgtttaggagagtggattccagctgtattcatgttgctgcaaatgacgtgattttgttcttttcatggctgcatagtattccatggtacatatggaattttccaatctaccttggattttcaatctaccttggatgtacctggattgactccacgtctttgctattgtgaatagtgctgcaatgaacatacatgtgtattcatctttttgttacaatgatttattgtcctttcggtatacccctagtatagtaatggggttgctgcatccaacagtcattcttagttcttaatttccaaactgctctccatagtagctgaattaatttacattgccacaaacgggttgtgttcccttttctccacagcctccccaacaccctttttttaagtttttatttattatttgtttttaacaaaagtcattgtgactggtgtgaaatggtatctcattgatgttttgtttggcatttttctgatgattagcaatggtaagcatttgttaatgtttgttggccacttacgtgtgttattttgagaactgtctgttcatgtcctttgcccatttttaatggtcttatttattttttgcttgttgatttgtttaggtctcttatggtttctggataataggcgtttgctatatccatactttgtgaatattttcttccattcttttaggctgtctgtttaatcccgcgatagtttctcatgctgtgcagaagctatttagctaaattagatcacacttgtcaatttttgttattcttgcaattgcttttgaggacttagccataaattaattgacaaatatgatatccagaagagtatttcctaggttttcttccaggatttttatagtcagaagatgtactcttatgtaaggaaagcacaaacatttttttgttttgttttgagacagagtctccatcaccaaggctatagtgcagtggtatgatcttggcttactgcaacctctgtctcctgggttcaagtgattctcctgcctcagccccctgagtatctgagattacacatgcctgccaacacgccttgctaatttttgtatttttactagagacaggtttcatcatgttggccaggctggtctcaaactcctgacgtcaggtgattcatctgcctcggcctccccaaattttgggattacaagtgtgagccaccatgcctggccaagcacaaaacttttaacataaaaagggaaatgaacattttagtgttttatttaattcataaaatgcaattattttggattctactaaataataaacatccatatgtggcaaagtgtttggatgccaatcattcagttgtgattatgggtgggaagaattgagatggtgcaaataaactttttttgatttttttttttattttcaagatggagtcttgccctgtcacccaggctggagtgcagtggtgcaatctcagctcctgcaacctccgtctcccaggttcaagcaattctctgcctcagccttcctagtagctgggattacaggtgcccaccaccacaccaggctaatattttttttgtacttttagtagagatggggtttcaccaccttggccaggctgatcttgaactcctgacctcgtgatacacctgcctcagcctcccaaagtgctgggattacaggcatgagccaccacacctggctggtgcaaagaaactttaaaagtggcatgggctgggtgcggtggctcatgcctgtaatcccagcactttgagaggctcaggcaggcagatcacaaagtcaggagttcaagaagagcctggccaatatggtgaaaccctgtctctactaaaaatgcaaacattagctgggtgtaatggtgggtgcttgtagtctcagctactcaggaggctgaggcaggagaatcacttgaacccgggaggtggaggttgcagtgagtggagatggcaccaagacactccagcctgggtgacagagtgagacactgcctcaaaaaaaagaaaaaaaaatgtggtatgaaccacagctaaactacaatcaattagagagtaagccaaagcatctcaaagtatatcatcagttatcaggcaataacatgcaatttctaaaacctaacttaaatgcagcttttaaagacatttcaaacgtgtcagtttagtcacatttattgaataaagttagcaaatggatatctcttgaaaatgagagctccagggaattaaaaaatgtaaagttcccatttcctttctgtgttaacacagctaattatgatctttacttcacatgcaaaagtcaacagaacaactcagtgtttcaccaaattataaacaagaattacgctagacaaatgaaaccctaaagagaaacggtcatataactaacatcagtcaagtagttctggcagttatttgaagtctgaggtttgaagtaggaattcttacgggcatttggggaatatattttctgttgagtcctatactagtaagattttcaacacaaggtgactctcgacctcgccttgtaggaagagtgctgagaaaatatttcacctgctctttctccataaagagctgatactgatcattgctattttcttattcgatctgtaaagatagcaaagacaaatgcttaatatttcatttttccttaaatgattcttaatgacttgcagtttttaaaaacttaccctgagagtaaaccaaattacccactaaatagtgttttcacagagaagatgtgtaagagcatacctgttgtaaggaattataattttaaaatcgttctaaagaagcaccattgtttctaaggtgatttctactgaacaagcagttcaaacaaagtagacagggaagagaaatggctatcagtgatgtatggctcaacaggtaaaacttcctgccttctaaaatggctctacttgtaagattctgaagattccattagaaatacttgtatttaaagggtaataatgtgggaaaatgaatatattgatttgcttgattataagaaccacttcactagaaataattatatcaaaacatcatgttgtactccttaatgtaggttaagaaaactaaaatgaacgaaaaaaaatctaggaatacttgtgtttagtaaaccagttttagatttcactcttgtacatttcacccattatctaggaccaattaaacatttggcactgaggaataattcagagcaacaactcctaggggagaactagattgtctggttggtgatcaaaaagaactaaagcatctctgaaggcaattagcccccaacactgtgaccaaggccctggaggtgggggcatgttctttctgccttccacacaccgcttcaggctgaacaaggtgttattttttaaccgctttgtgaattacacttctttaaattcctgtgataattattccctatttcacaagggtgcctttctgtaacatcttgaatatgttacacaaatagtctttcttgaggcaccctctggtgataatactaaagatcacaatcaaaaacaattgtgcccagagtagcagtaccactttacatttaggttgtgatccactgaaaagtaaattaaacacattaatatttctatttagggaaattctgacaagtaattttataacaagatcacttcattaattataaaacttcaaaaatacttagtgaaaaaaactaatagatcaggttaattacatgagacttttcaggaaaaaaagccatacaaaagcaaaaaaaaaaaaaaaaaatgagaggagagacaaaaactatctttgactaacattttaaaggtaaaattatttactaacattatttttcaaaattacattgtcaaattagcattcacttccttctaatctcctgaagccatctcactaaaaattatgcttttgaaacaaattaatgagcttaattcattttctatgagtgtatgttttgacttacttagttaatttttttgacatggaactgttagctttcaatgctgctgcaaagccttccttatattcttctaactcagttgtaacctcttcataagcagttttcattttgtagaatttacattccacatctttaagtgtgagttccttcttatttagtgaagctgtattatatccttgtttaactgctctaattgttttttatattgtgcttgttcctaaaacagaggaaaagaatacacttttaaaacaattataacctaattattatgtttgttgcctttcattttgagtcagtgattcaaagagcatttttgaatatgttaaaaaagaggatgaagtttaaaatatttcagcaatatcaaaactaataactgaattcagaattaagtctgatttgtaaaaatttgaaatcataattatgctagtattaatgtaatctggtcatataaaaagtaatagcatccattcatagttttaaaaagtgatcaatgaacactgtagcttaagaccaattcataattatcacataatttctaaatcacaattttttcctatgccaactggtcttaatcatcaaatgactccataatgagaatcattactctgaaagattgattttgttataataataatggaaatttaaatatttaaaagaaaaaacagataccatttttttctagaactctacaaagcagattgctacaagagaggcagaggaaacactatatatatatatatatatatatatccaaaatataatttgcagtgaaataaatgaaagcacattacaagtaaacttacctgatttaaacaactcacctgtaaatggatttcttctaatttttctactgcctgcattgccctttcatctagctctgatttatattcttgtagtttactaagttctaccatactgttttccatatgtgtcttaagatttaatatttcttcttccaacatctttttatcctcctcaagtttttcacattcctgttgtacttttttcatagataataacttctgttgaaaaacttgattctctttagccaaattgacacattttgaagatacagcttccttctccaccataagatcatcaaactgcatgaataaaatagtatagcttgataatgaagtaggctgagaataatctaatacaaaaccaatagcaaattttgaaatgcatttacttgcaataaaatgttatctgtaatgcagcagattcttcaaatgtgaacccttaaattactcagaattttaagaacaaagttaaagctaccatgagtcataaaaatatattctttactatcaccatctttgccacagaatttttgtacttcattttacttttatttttctgataattcatttttgttcctccttaaatggcacaaagttatctcctagtaaaaagtgtctaacccccttccttcattattattccccacaatatgtcaaaaaaagtttcagagatatcatattgagttatttaggccaaagtcaataaatgggtctaggaataagactttgaaaatgatattacactctatattaggcatggtggctcatgcctgtaatcctagcactttaaaaagctgtggcagaaagatcacttgaggccaggaatttgagatcagtaagagcaacatagtgagacccccctctctacaaaaaaaaaaatttttaattacccgggcatggtggctcatgcctgtagacccagctagttgggatactgaggcaaaaggatggcttgtacccagagttcagggctgcagtgaattattatcactgcacttctgcctggatgacagacaaagaccctatctcaaaaaaaaatccacaaaataatgaaatctatgattaaggattctgatgctataagcctttccttaaactgcaaatgtttcatgctaatttgaattgcattttaagaagtaatgattcttggggtaaagaccatagaatacggcacccagaaataaatccacatatttccagccaactgattttggacgaacatgccaagaacatacgctggggaaaggacagcctcttcaaatgaatgacactgggaaaactaaatatccatatggagaagaatgatactagcttcctatgtaacaccatataacaacataaactcagaatcgattgaagactgaaatgtaaggcccaaaattatcaaactactcttagtaaatatagggaaaatgcttgaggacattagtctgcacaaagatttttatgggtaagacatcagaagcataggcaaacaacaaatcatagacaaaagacactacattaagctaaagagcttctgtccagcaaacaactgagcgaagagaaaacctgtagaataggagaaaatattgtcaagctattcacctaataagggactaatatacaaaatatacaaaaaaactcaaacaacttcacagtaaaaaaaatctgagtttaaaattgggcaaaatatctaactatacttttttttagaaaaagaaatacaaatagccaataaataaattttaaaatgctcagtatcactaatcctcagggaaatacaaatcaaatctacaatgtgatataatcttgcttcaatttgaataaattgctgtcattgaaaatacaaaaaaataacaaatgctggtgaggctccagagaacagtaaactcttacatgctgttggtgggaaggtaaattagtgcagccgcaatagagaataacaggaggttttctcaaaaaaactaataatgggactgccgagggatccagcaaccccactaccgggtattcaggcaatagaaaagaaaacaatagatcaaaaggatatctgtcctcatatgtttactgtagcactatccacaacagcttgtgtatggaatcaacctacatgtccatcaccaaatgaatggacgaaaaactgtggcacacaaacacagtggaatactattcaccgtataaaggaattaaatcctgttattcgtggccacgtggatcagtctgacggatgttaagtgcagacacagaaagataaatactgcacattcttactcatgtaagggagctaaaggaaaattgaaggctgggcaatatggctgatgcctgtaatttcctagctctttgtaagaccaaggcaagagaatcatttgaggccaaaagttccagagctccctgggcaacatagggagatatctctacaaagtcaaaaatcagacatgtgcaatggtgcatgcccataatgccagctgctcaggagactgaggtgtgaggatcagatgggcccaagagtttgaagctgtagtgaactatgatcaaaccactgtctccagtctgggtgactacagttgcccagagtccagactatactagcaagaccccgtctcttaacaaaaaaaaagctcacagaagtaggggaggggaggctggttaatggatacagaattacagttagataagaggagtgagttctggtgttctgtggcattgtagggtgaatatggttaactatgacttattgtatatttttaaaaagccagaaaattttgaatgttcacaattcaaagaaatgaaaaatggttgaagtagtaaatgtgctagttagattgatcattacacactatatacatgtataaaaatatcactctatagcccacaattatgtatatatgtgtcaattaaaacaaaagagaagctacattcatcccatttaaaaaacagaatatgggccagccttactgacttccttctaatgagtagaatgtagtgaaagggataccatgtggcttccctatctcagactgttttcccttggaaccctgccccaattgtgagagccatcaggccacaaagagagcctgaaagtgcctgtgtcagtgttcatgctgcctgtcccaaccaagtttacagccgatggccagcatcaaccatcaaacaagtgggtgaccaaagcttcagaggattccatttccccaactgatcagctgttcctagggaagctgaagggagcagagacaagctgtcttggccaagtttttccccaaccacaggttcatgaacaaaataaatgtttttctttcaagccacaagactctgggtaattgttaggaaaataagttttaaaaagagacaacaggaaacataacttatgcagcagaaaagagtctcctttaaagcaggatctaataaaggttgatatttattgatgtcaaacattattgagaagcagtagataaccaggagagagacataagctgctgaggaggaattttcctaaaacaacttcaattatgaactctgataacaaggcaagggtgtcttcttacaatttcccctcaagttaggaagtaagactgggaagcaagaagatgtatgatttgaaaaacaactagaaatactgggtgacataggcaaaatcagacatttacctgatttcaattaactaaaattctaaaagaagaagttttgagtatttattaatcaacctagtattcaattttcattttcttttctaaatgaggaaataaggagaatattatggaatgatttttattcttcacagaagtaaaataagcatagtgtgttttgagtgttaagacacaaatgcaatttctcctttaccttactccaagcttgtttgtatggagaagtaaaaaccatcccatctctatgttatgccacaatgcttctctatagcacacaacttggctctgaaattttgaaactcaaaatactaatctactatgtgtctctgataaattgcctgaacgttacctgattttgaagtgctgcactcctaagactttttcttggaatgaattaaacgttttattccaagaatcctctactgagctagaaagcagagctgtgcatctctgtttcagtaaaaggaggtcaatacagggaactgtggtttctgagaatgcaagatctgcactaagaaaaggattagccacagtgctacccaagagaaccagctaccaggagaaaagagggtctgtaaactgcaagatgatgacttcacttgatttccactgaggaaagctggtggctcagacttaaacttctccttcctagatggtaaacatctatggaaggttctatgaattataatgagttagtaaaacataatgcactgaatattagactatgtcagcagatcctgtaaccaaaacttactgaaaatataactatagtgggaggtaatggaaaagagactaaaggcttgaatggagaaaaaaagaaattaagtgtgtcttgtaagcctggcgtctgatcatgtcttagaggaagtaaggtataagctggccagagactcctttgtgacacaaaaggtgaagttacagacattccactaaatttaatttttattatgacataagataactggtaatatgcaacatgattgaaaaaaacttctcattcaattcgattgggccttgacataagaatagacataaacaagctaagaattgacaatctaaaaataagcctgcacttttacagtcaattgattttatacaagcttaacaaaagaacaaaatgggaaaagaatagtcttttcaacaaatggtgctgggacaactgggtatccataagcaaaaaataaataaagttcgaccaaatatcttatttaataattaactcaaaataaaatagttaactgtaaaagctaaaactataaaaccctcagaagaaaacactggcataaatctttgtgactgcatttgccagtgttttcttagctatgactccaaaggaaaaatggattcaatggacttcaaaattgaaaactgctgtgcctcagaagacagtatgaagaagtgaaaaggtaagacgccaagtagaagaaagtatttgaaaagcgtgtatctgataagggacttacatatataggaaatataaataactcttgcaattaataaataacaagataagccaattttaaaaaatgggcaaagattttgaatagatatatctgcaaagaagatataaagatggataagcacattaatagatgcttaatgtaattagtcattaggaaaatgtaaatcaaaaccacatgtggtatcacttcacaccacaggataaaatctttgttcaagaaaaaagagtgttaggaaaaatgtaaagaaattaaaacctttatctaatgctgctgggaatgtaaagtgatgcagccactttggaaaacaaactggcagctccttaaagggttaagcatgaagttaccatatgacacagaaattccagtcataagtatatactccagaaaaataaaaacatacgcaaacacaaaaactcatacataaatgtttacagcagcattattaatagtagtcaaaaggtggaaagaaccagaacgtctgtcacctttgggtgggagagaacccaaaggtccatcacctggcgaatggataaataaaatgtttgatgtatccatacaatggaatattactcagcaataagaagaaattaagtacagataccgtattaggaggagacagcaaaatgcctaggcagatacggaagggtccccggagaatctccaaccagccccacaagtgtttacaccagatgttatgtgcagataagggaacctggacttgtcttgcctggacatgcccacagcagaccggaggcccacatgcagtggggggatggggtggagtcaccaggaattcacgccttatgcagaggaggagcctggccgcttcagctcatgtgatcctggtattcaattgtgaggtggaaacctctttgcaggacccctctctttgctgagagctgtcctttcacataataaattctgccctcctcaatgtgtctgcatgcttaatttttcctggtcacgagagaagaacccagatgtagctgaactaaggagcaaaaacccggcatcaatacctgctacagcacagatgcagcatgaaaaattatgctaagtgaaataagccagtcccagcagaccacttgctttttatttcagaggcttataggcaaatctatacaaagaaggtgggtggttccctagggctgagggaggaagggaaagctagtgaagatggctaaatgacgtggggtttgtttttagggtgatgaaaatgttctaaaattaattgtaatgatgatggcatagctctctgaaaatactaaagttaatgaattctatactttaaatgagtgaattgcatggcgtgttcattatttctcaataaacctgttaccccccaccccaaattaatttggtactagagatctgcagataggtactgcttggtttcaaatcactggccagggttcaaggtctaagagaatcaacaacatgtcctttttatagaaaaagagatttatattttacaagctatccttttcattagtatcaagtctgtaaaattcaatgaaaaatctttctttcactgcttaaagcactgacagatttatatagaggaataacaccttgttttccttggccccaatttctatctaaaggtctgggaaacacacccttcaaactatcaaatctcatcagatgggttttattaacacttataatgtggcttcctttctaatctgattctggtgcagcatcacagagagaagaagctgaaggaaatcaaaatattttacccccaaatatattttttgacgtattttgaaatggctgctgcagggccaagagattgaaatggccctcattaaggtagcccaatctctccccttctaggtcttcccagatctggggaagattaactaagagcctgaggcatttaaagtttgaaaagatatatttaccctctattttctcaacatattttggcagaatttggatttttccattatcaatattttccaaaatgcatgatttttaataccaaaactgatttaaaattaccatactttggaatataaattattctataaagatacatgcatttgcatgttcactgcagcactattcacaatagtaaagacatgtaatcaacccagatggacattatcagtgataatgggataaagaaaatgtggtatatatacaccatggaatactatggagccataaaaatgaatgagatcatgctctttgcagggatatggatgaacccgaagctgatatcttcagcaaactaatgcaggaagaaaaaaccaaacactgcatcttctcacctataagtgggagctgaacgataagaacacatggactcggggaggggaacaacaaacactggggcctgttggggtcaggagggagagcatcaagatcaataactaatgcccacagggcttaatatctaggtgatggattgataggtgcagcaaaccatcatggaacacgtttacctatataagaaacttgttggccagactggtcttgaactcctgacctcatgatcttcctgccttggcctcccaaagtgctgggattacaggtgtggccaccatgcctggtggctatttctctttttaaattctctcaggactcctaaaatctcaaaactttgacctagattccctaatctacatttccagctctgaccattttcttgaggtctcttccttctagtacacatattatagaaaatattctcaaccacatgctcatacattgctaattggtgcagattacttttgtagatatagtgaatgttgtctattttatgttggttctcattaatgttactttgagtatactgttattttctaatctcaaaggggtactatctcactgttatgatactaaccagtatactttgtcctttttttcttgctttcttcttttttggaccagtatactttgtcccttttttgtttttctttttttcttttttttgagatggagtcacactgtgtcatccaggctggagtgcagtggcaccatctcggcttactgcaacttccacctcctgggttcaagtgattctcctacctcggcatcccaagtagctgggactacaggtgcacaccaccacacctggctaatttttctattttcagtagagacagggtttcaccatgttggccaggctgtttttgaactgctgacctcaggtaatccacgcacctcagcctcccaaagtgttgggattacagacgtgaaccatggcacccagccctctttttcttttatgatgaaaactttcccatgagaatcatattatcaattgtttgcctttgttttcttttaaagaaattccttttccgtagagatatggcatgatgaaagtcttgttctaaagtttcttttgggggacacttaactatgtcattgggaagcttcagtaagtagagatctcccttcttctcactcaagattcttcatctcaaaatggtgtccaccaaatgtcttaatccaggtaatcgcttgtttagaaattcatgaaataagaaccttctcgagaagttggaggctattgattgagatggtttaacgctgcccattatatgttttactcccaaggtagacatcaaagtggctaataattctatgactgatgtctaactcacttctatgggaatctatacaaaactttttatttatgagacagagtctccctctgttacccagcctggagtgcagtggcttgatcactgttcactacagcctcaatattccaagctcaaacgaccctcctaccacagcctcccaatgtagctgggactacaggcgtgcaccaccatgcctcagataagtgtttaattttttttttttttttttttttttttttgagacagggtctcactatattgctctggctggtctcaaactcatgggctcaaacgatcctcctgcttcagccttccaaaaccaggtgtttaactggggactaacatgaaacacttagaagactacgtggaacacagtgagctacataaaatatttgctattagcataataattttattgtatatcttaacaaaattgtgtattttaggcaggtggcatgccaatggaagtactctcctatagctgcactgaatcattcttaccactgagagttgcagcaaatgggggacataatttataacttacttttctctctgtatgactcattaggcaatgactatgtatgtactacaatgtaaacagcacctcctggattgaatagtacataactgacatgaccagcagagacaggctaaagacactgagctgaaaaccctggactctattgctaaatcaaggctcctgaatccgttccctctgagcaactgttgctgtggtgctgccttcacaagcactctgctgagcactcagattgaggggctgtgctatccatcatcggacaagctgcacccagaactgttcagctgacaaactgggagcagtccagaaatacagttctgctgcatagtgaaaaaaggccaatttagattctttttcatagagagaaaaacataaacatgtgatttaacaagtctcctgtagtagactaattggtttagatttaatatttaattgctaaaaacacacttagaatataaaccttactgtgtcaaggtctcaaagaagaaataattggtatggtataaagtattgaattgtatgctacaaacttctaagctaaaatattttcaatgtatgcaaggataggtggcatacatattatatattattcccccattaagcaaatttataatgagagaaaattatcttccataaaaaagccatgtaaaattaagaactaagtttttctgcacagactagacaatgattgctaacacataaggtcaatgagagaacagtcagagaaagcttcatgaaaacaataaattgtctgccacgtctgagtgaatgaggctagatgaacagaaactgagaaggtagaaagaatagcatgagcaagataagtgctgaaatctgcccaattaactctgaggataaggtccaatggcagagaaataaaaacccatgtccacataataacctgtaagtgaatgttcacagcagcatttttcataagagctaaaaagtggaaactaacttaaaggtccatcaactgatgaatgaatggaaaaccagtatagccatggaatagaacatcatttaactataagaagaaataaactaccaatgtgtgctaaaacattatgctaagtgaattctgaaaacattatgctaagtgaaaaagccagtcacagaggactatgtattgtataactctatgtatatgaaataagcagaacaggcaaacatatggagacaaaagtagatagatggtggttgcctacaacagaggtaggtggagggacatggaggaaggctgcagtcatgcctaggagatgtggggttgcttttcagggtgatgaaaatgctgtgaatatactaatagatactcagttgtacattttaaatggttgaactctctcaaatgtgaatgatatctcagtgaaactgtttttaaaatccaaaggcaggatcaagataattttctcaactctcaatttttgatgtacatgttatctcaaatttaattatttccacagttttatagtatattttaaataaaagataaagaaaatgcctaacttttcaaatagtttgtaaattaacctaaaacatgcacttttaaaagaatagtataatggcctttctgtacaagttaacctagaatctgtgaaataaatagacacagattctgtgtccactcacaaaagtgaagaaataagacaattttctggaacattccatgaaacattcttctctgatttaatctggcccgcctcatcagagcaatacaaaaattacttaaaaatactgttttaacaggacaaaagtcagttttctatgaggaatgatgtataattctcaacttttccaagggtacatattgtaagagaaaagatatgcaatggtttttcaaaatggtagaatgaaagtcactatataaaaaaataagtacattatagagatagtaaaatggaaataattcattgtaatgaaaataaaaaatcaagcttctgccataattagtatcctaaaacatgttatgtaattcaactagctacagaataacagttgacatgctaagttccatacatacttgactttccacttgaaataatttcttttttgggacctgtgtctcatccaaattaatgtgataatgtgatatgccttccagtggagactctaacatagttaatttttttaggctgtcagccgcttcttgttgaagttgtctcacaaccacctgagaaaatatttttgttactgattttataaattgccttattattaaattatgttaataatatttaactctaacatacctactttgaaaattatcaccacacatatcaattcaccttcttttaatcacatgtacacatttttatttattactgaattcagtgagggatgcacaatatgttctcttcctgccaagttggttttctcttacctacataacagattcatcccaccattcaatcatcttagaagctcaactcaacctcaaagttcctgacatattcaatcacctgttcaaatccttccaacagattcctatctcagaataaaggtaaaattcccatggcctttgaggtcctaggtaaacaggtctctacctctctctctgacttcaaagctccttcaactccctcctgtaattactccattcccactgtacgtgaagcctgccacccctcagtctgaaaatagggatctaatgccttactcataaatcacaggcagctacaagtatctttgtactgaacaaaattatattccaatgatagtcattgagccttgaaataaaaattaggagctaattattaatataaatattcaaagtaaactataaataccagtgggaagactaaaccaaatatagttttgctaaatattaccacatgtatcctaaattatgattttataacaagtaggtgcctttgaaacattacatagtcataaaaatatgtaatttgacatattttcagatttgttaaattaatatgattaataacaaagatataccaactaaaatacataaaaagctacttaaagcaaggtatcacaagacacagcaatacacttcagttcatctgggaaatctagaattaagtgttaaagaaaatcaattaaattttaatttgaaaatactcatttcaggtgtaaacatttccatttatacttacattatggtcttaacatgtggcaacataaagtcattaaaattattatttcagcagcacagaactatctaccttaaaatatgactctgtccctaataaaatttcataggtgacacaatgtcttttctcaaagtaaatcatctctcacctctaccttttatttcctagaaatgaggcacgtttctaagctggtatagtaaacacggttttccttttttttattaaaacagctttgttcaaatataatttacatactatagaatgtatctgttttaacttaaagttaaaagattttttagtccatttactgagttgtgcagccatctctacaatccaactttacagcatttccatcactgcaagatccctcactcccattagcagtcactaccagctttcagccccagccctttgcaaacattagtctactttttgtccctatacgtttatcttttctggatgcttcatgtaaatggaattatacagtatggtaaacacactttttatccattgatttttatattcaactaagttcaacatgtatccagaaccaaatgtttaaattttctttctaaaagtttgaaaatatttatcttccttgatacttactactctttctgctttctctctctcatattgaaagagactttcttttaaatgatcacattcattcattagcttcttatttttctcttctagcatgaggtctttctttccactctcaataaagcctctttggatattagttactatctctttatgatcctctttctgatgaacatcatctagttgctgttcaatgcacggattttcatgttggagatgacatatcctctcttctacacagctccactttccagtggaattattcactttatcttctgcattttcatacatctctttcatttcctttatttgctgctgtgtttggcttaggtcgtttggagagtttctaaagccgatgacttttttctgagagtatctcttttcttacggaacttatcttttaaggtattgagtttaatttgcattttagaaagttgttcagtaagaaactcattcttatcttctacttcggaaatatcagaactcatttttacttgtacggaaacgtcttgtgttcactctaatgcaagttttaggtttctttctgttttcacactttcactgtgtttacttatagcagcagtcagtctagactgatgattcaatttcagcttccagtcttttgttgctttcttcttccttcaacagttcggaattgagccttgtattctcagctttgagatcattaagctcttgttgataccggaatgctgtttttgttatcaattcctcattgagttttatatacttttcaagggcagcatttgtttttttaacaattttaacgtccttaagatatttattttctttttccacattgtcatttttcattgtgcatatttcctgtctgagtatagcaatatctgtcttcaaaatgcaattttcatccatcagatctttcatttcttcctgattatgaaaatcctaaataaaacaaaagaaagttttagctagtatgcaataaaataacatatcatgattacctccgaagttaaagagtaacctgcacatccatatactaaaaaggttactgtaagtggatatccaactggagaaaaagttgaagcaaaactttgaaccttatagagcataagttccaaaaagttcagaaatttatttaaagtcaatgaatttataaaagtaaacacacacacacacacacgcacaccagagaatttttaagaatttcagaattagaaaagcatttccctgaattacaacaaactcaaaagcataaattaaagcattaacaaatttgactaaattaaaatatatcaaaaaattgcatttacactttgatatctaacccttacaccaccctatagtaagaactttacttcacatgtatttggacagataaaatttcccagagttactacagttctatttcactgataacattctatttcaatttgactcttttaacacttttatagtcagttgtaagaattacatttactaaatcataaatctagacattatactagtcactcctatatacattcattgatgaactcatctagttaccagaattttgaaaaagaaatgttaaaaatataagcaagatacaggattttccccaggacttctgactctacttctagttctctgacagatcacagttacttctgtggtgtaaatgtatcaatacgaaagaaaacttttatttcaaaacaccaatggtaaataagataaaatttatagagctcttcttagaatatcatgagattatttgtgattgcaataatttgtttcctctttatagtattaggtacagtaatcaatatgaaatagcgggaagtacaaggaacaattttactgggaaaaaaatctttatcaataggttatcactaagtatatattatggcatattattgttttcaaaagctctttgtaataaaataatatcctatgtggatgccaagatttataataaatattaataattgtacctgtaagtgtcatcattcattttttgaaaatgagataacatttctggtttgttttataccaaaatattatatattaaatcaagaggatattataagtaacattgataaaataaagtttaaaatatagaatttttaacaaagattgatttatctgatttggagtatttcttgtagtcttcagtttcatctctagtgattgaacagttggttcaagttgttttgcttcaacttctttcttatattgtttctctttcctttctaattcttctctatttttttgtacagcatattaacatttgttttttcttcactttcttgtcttaagatgcatctgcagataaagacatttatcttaaaattcattttgttaaaaaacaaagagatcatcctgtgatctacctctgcagatgctctttatcatcctaataaaatttctatgttctggattatttttcctttgtagttctcagatatttaatttctcacttcaacatcttcaaacgaatgtatatacttgaaaagtagtaaggaaagaatattctgctaaagtttttgttactagtcactctagtatgtattataaaaaaggatactggaaataattcagtatagttagaagttcaaaattaccttttcaaatcacacagtcataattactccccgattagaaaaggtcatttacaatcaactgaatttttaaagttactatttattgacaagcgtataagttcactagaaataaattttcatctctatgaaatattgtaggtgtctctccaaatgatttacagagtaagatgtgtctcacacaaactatatctgcagatgattgtcatctaaaactaggctaaagagtataacatctgttaccccacactttttataattctttcttaatacttccaattcaccttcttattacatatattttatatatttattaagctattgttcattatgtgtaatatataattaatgcccttaataagtgtgtgtatgtttacacaagttatgttttcctgtgaaatctagtcccagaagtggagttgttgagttaaagggatgtcaggttatttgaaattttgatacacagcactaagttaccattcagaaataatttaccaatttcatataccaacagtgtatgagaatgcctttttcctcacattttcaatggtagtaattactttttcaatatcagcatgactttacaaaatatatcttattttatgttaatttgtatttttctgattaccagacagggctaaatatccctggtaaaactataaaacttgttaatcataaggaacattagtccaattttgaattagtttatagcacaatgacaattatctgctgagaaatactgctgtaggtggccaggcacggtggctcactcctgtaaacccagcactttgggaggccgaggtgggcagaacacctgaggtcaggagttcgagacaagcctggataacatggtgaaacctcatttctactaaaaatacaaaaaattagttgggcatggtcgcacatgtctgtaatctcagctactagggaggctgagtcaggagaatcacttgaacccagtatgcataggttgcagtgagctgagaacacaccattgcactccagcttgggcaacaagagagaaactccatctcagaaaaacaaacaaacaaacaaacaaacaaaaacacactgctataggcttacttacctatcatgctcttccttcagtttcttgggaaattgctgaggatacgttttcccaacctttctttgtttggttaatctgtcagcagcagcagaagatgtactatgacatacattttctgatagttgtattttttcacttttgtttgtattatttccttctttgacctttaataaaagtaatatgaataataattattattttattcaataaaaaaactttttccctgattttttcacttgattcaggttaactatcaccattttaatgataaaagtattttgtgcttactttaattttatcattatacataataattataagacacttatcattttatcattgaaatttttgtcaagtctgctcatttctgtttgagtgaatggaataattttccaaaatttcaaaaaggactcttctccattttgtgcttttattcgcatccactctttgctatctgatataaatgtttatgctatctgactggcagaaacagagaaataaaaagacacaggcataacatatatcttctgtcattgccacctggattttacatgaaatagccagattaagaggatgtgaccttgtaggccttcaggaagagtaaagaagttttcccttttctgcactgagctattcttttccccactgccttttatctctttttttttttttttttttggatcctgggatatcaaaaaagtgaaagttctccctgaactatgggaaccaatgtttgccacaacacaagaagcagagtgaaactgctgagtttctaatgcagaattctggaaaacgagatgcttcccagatttcacattcaattaccacaaacgtttataggtggaaaacatatggtacagctaactactttagccccattatctactgaaaatgggagtcaaaccaaccaagacatatgaaatgtttcatccagagctcttgaggtggcattccctagcatttcatggcaccaaataacatgatacaattccatattgctcaattacataaattaccagataaatttatcaaattagtcagatatattaaaagtctaacttgagcaaagcaatttaacacctcagagggtggaaaaaggcgtggaaaaaggcctcatctgcttttactttgaaagaagaaaatctctagatttttgtctatctttagaacacaatgtacagaactcaactttctactaaagagtcaaaggctaaatttttagctaagaaattatgcttctttcttacatgataaaaatcatacatgccaaaacttaccatactttattaaacaacataatgtaaggtctgattcaacagaaatattggagtggtgattttttaaaatatgtggaagtatatatttgttttcaaaatattggaaataaccatgatggaactataaattcaaacagtttgagctaagcagataaactggcgtgcatgaaaacacattaaacagactcatttggctgggaatattcattgcaactctcaaggctagacgtgtttttgtggctcatctcagtcattgcttccctcccattgtattcccattctatcattaaataaatgtaattcatctctaaatgaatacagaaaaaaagaatctagaatgtaaagcttatttctttagcaatttctttatgttgatctggttcagaaggtcacatggtatatggctgaattagtttcccagctcatatgccacttggaagactgagagtgagacttaggttgattaatgaagaaacattatgagaacattctccagaaccgttgtttagatagcaggactaatctactttgacacatgattacacatttagaaaaccccgctgtaactgtacacatgagattttcttgaatagaaaatttgactaaatcaaataattgataaagagaaaaaagaagcagcaagtgaacctctgtctttttgaagttggactttctctttctccaaagccaggaactctacttgtaacatgcctacctcattctttttactattattatactttaagttctgttacatgtgcacaatgtgcaggtttgttacatatgtatacatgtgctatgttagtgaccttggaatatcttgctgtaagtcttctagctatatttttgatgttctctcactatgtggcaaagaataacccgcattttataattcaagattcatggttttgtagttattaacactgggattgtcatacagcggcttctggaataagcactgtgttggttttctgtttttataagtatctgtagcagcagaaatactgtgactttctatctgaatcatatgcttcatttctttggggtgggtaaaccacaaatcaaaaagactttctggatctctagactgagaccaatgcctaatttccaattagtggtatttgggtttatatatttttccatttgcatgtcaaactcttaatcatctttcatttcaatcataattactgggttccttactttttcagtttctatatcataacaaaaatttccatcatctgtgttagaaacaagctgtgtgtctggtttgttatcatttttatagtctgatttattttaatttaaatgaagcttagaagatgactggtaagtgtatttcagggacctggagtgtgaatggaataaaaagatatttgacatgggcttcctctgttcaggcgctgcctggactgccacagagctagaccctccagatacatttttctcctcacaatcagggacatgattcatcagactagagggcactccttttttgttcatccctctttagagttaccatgtaggagctcttcctcagggcaagcagtaattttggagttttcagaacttttaccaatattcagcttgaacttgtttgtaatgaattttaaagaaagtcatgaatatatagattgattccctttatcactgttcttacccagttctggttcttgagactttttttggtggggggcaggtgcaaaatggaaaacaaatttgcttgttttgtttctcagatgtcttttctgtcagagtgcatgttgtaaaattagctttaatcaagtataaacaaagaaatattagaaaataattaaaatttaactgtgaaacttaatctatgtgttgctactcttaaattatgggattgtaactaaaaagtgaaaaataatttgccttggcttaacataggacagaaacatgaaccagcaatctgaactctcagtgtctgtttggactaaacttaatgcatttgtgtaaaatctaccagaaatgaattcaaagatgataggtagtattataaaagcttcctctcttacaaagactttacctcagcataccagaaagagtgagcccctacagtgcatgtttatttctgaagattaactagagcactaggcaaacactaaattattaagagctaaactgaacaccagtaagaaagagaagcaaaattttaaattctaattcaaatgttatactatgatagtgttatgtatctagatagaatttctgcttatatccacttctaatatattttaagttccggtagtgatagggtttggattttttaaattttagtaatgcttactatgtatttatgttgaaataaagttattgttcacaccctgacaccaaaggtcccattctgcaaggtaggattctcttaataggcaactgcattgacttttatgaccccattcactccctgaacacagacacagaagtcaactggtgaccataaaacagaataaatctttaacctcggcactggtgaccagcaatataaaactgcaacatttgaagcactggcaatgatgactcctttaacactagtttaactcagtggccattgttgttaaactgttcataatttctattcctcagtaatatgacccaatacttcatgttaccttgtgtattatgagtaaggttatataaataaaacagcaagataattctgaaaatttcttgcctcaattccaagggtaaagacagctatgagttactagagatactaagaattactagaataactaatagttactagagatagtaagaataacttaagtttcataactggttaagatgttttaaaaattaaatataaaattatgatctattggattctaaaggtatagtctgaaaggtcatgtcatttgtactatgctttgttagtaaagcaaaaaaaaaactaatattaaacaagaacttaaattttcatatacctgtgattgcttcttttcacttctttcacacctttcttgctcttcctctaagccactggtaaggtttgttctgttgacaaattcattgatttagttcaaatgaactaagaagagttagataaagactataatctttataaaaataaatagagaataacatttctttgtattttatattttgagagtttgaatgaaacaatgtttactgaaatatttacttctgtaagaaatacttctaattatccaaaacttcaacaaaacacttggggagacaccagatatcaccagattcaagccatgcaaaatctcagggtcactcacaaattgttccacccaacataagtcaacaaaactgttggaaacaaaacagaaatttgaaatacagtcaaaatatacaatgtaatgctttactatacttcataacagtatctttttaacaagactctaattgagttggcagttactaataatttgcaaaattattgttctttatacctcaattagtgtgcaccccattttttacatcacaaatgttttcccctgctattctgaaaaatttattttcatcttttaaaactcagaaagtaggctgggcataatagctcacatctgtaatctcagcactttggaaggccaaaatgggagaattgctcaaggccaagagtttaagaccagcctgggaaccataggtaaccttgactctacaaaaaattagacaggtatggtgatatgttcctgttgtccccgctactcaagaagcttagatgagaagatccctcgagcctaggagtctgagatttcagtgagtctcaatcgtgccattgtactccaatcctgggtgatagagtaagaacttgtctccaaaaagaggaaaaaataaaggctcagaatgctatgtgaaatcttccttgattctagctatctttctccacacacacaggtgtctgcttcgttggggtcccttagtaccttgtcaatttttctagtgtctctttaccacctgacctgcacatcatgtctttacatgttgaccccctttgctgctagactgtagaggacaatcttttgaatcatctttgtataaacagtcttaattttgctaaataattacttattgagttcctgctaagtgttaggcactggggaataaggaaggaaaatagaagctgtcagggatggctttcctaaagatcatccatgagctgagacttagagagtgaggttagccagattaagcgaggcagagggcaggaaagggtgagcacatgccaggcagcaacaagagaggaagagaagcctccaagagagtatgtatttctctgcagaagaggaatggtgagggggccattaccagcagctcagtaattccagagaaaaaggcagatggggaaagggatacagatggagatttgggcagaaatcagtttccttttcttttcttttttgggacaaggttatactctgtctcccagactggagggcagtggcatgatctcagctcactgcaacccggcctcccaggttcaagtaattctcctgcctcagcctcctgagtggctgaaattacaggcgcgtgccactaccacctgctaatttttgtattttattagagatggggtttcaccttgtcggccaggctggtcttgaactcctgacctcaaatgatccacttgcctcagcctcccaaattgctgggatcacagacatgagccaccgtgcccaacccagaagtcagtttctgaaatccttatataaacctttaagatgcttggacattaggtattcaggagtggttcacggatctatttgcattagggataattcactctaaatactgtgaggagcataaaattctgaggcatataaatcaatgaacaaagataaaatataaggcaatgttgcaaagatgatgcaggcctgaggagatgttttcagaaatatttaggatataggtatcagtggccattataagaatgaatttctattgaataaatacatgtatatatctgggtccctggagaaatacactctgctcattactttacaaattttatcaaatgagaagtaaaataatatacataaactctttcagttacttgtatttactttaccctttttctgtttcagttttactgtgccaaggaaatgcatttgtgttttgtggtggttgttgtggttgtggttgtggttgtttttgttttttgagatggaatttcactcttcctgcccagtctgaagtgcagtggtgtgatctcagctcatggcaacctctgcctcctgggttcaagcgattctcctgcctcagcctcccaagtagctggaattacaggcatgtgccaccatgaacagctaattttgtgtttttagtagagatgggtttctccatgttggtcagtctggtctcaaactctcaacctcaggttatctgcccgcctcagcctcccaaagtgctgggattataggcactagccaccgcacccagcaacatatggggattttgttttaaaagttctgtttcctggatctaccaatctcatgagaaaatagagcaaacaagtcatttgcatgggtaagaaactttggatttatagcttttcctcactactctagaagattatcatcatgttttgcaaagcaaaatgttaaacacagacataaggggaaaaagaaattaaaactataggggtgggtgaaaaaatattgcataatttattactgttgacctcatcatatgactgattaagggcactgaatttaacttggatgtgaagtagacctcatattagctgcagttaatcagtagaccaggcgtcctagcagaattaaatttgatgctcctgtgttatctttaaatgacacagcttttctgaaaacccttactcatagtgcatgattatccattaagaaaaggtgatggaatatgtgaatacagctgaggagacaccacaaggcagatgctcagtggttcccattaatattgggaaaatcaaccctataaaacagaaagccatagacattatttaatatttggctttgggaggtatttttagtgacactgcatacagttgtacctaataattgctaaattagagatgtaaaagtaaaacaaagtcacattgtgtttgagtaggaaatctatagacatctagctggttttcacatccagccacaaaattctaaatataatcatggtacctgcactcaaatttatgttaaataccaacctcaatgaaatcactctttcttctcattctctttgttatttatatgttgctttccttaagggaagaatacaaatgccttgctaagaaccattctgtttggttgtaggctgcgtaaggggagtaaacacaaagtacatttgaccacaaaatgactttttaaaagtcagaaatatggtagcatgaagccaaacgaggtaatctagaataaaattttctatgattctttcccttctttgctctctttctactctaataactgcgattcacacaggtaatgaagagtgtaattccttgatagaaacacagctccaagattaatcctttctttaactatgaagttcgcgtgtccaaaatctctggtagttgctgtctgatttttgatcactgatggtgatacagatatttatcatcaactcacaacttcccaaatctttgaaaagtcttactattgatggttcaactagtagaaacatgatgtaaaatatctgaaaataaagtttttatttattagaatgtaaataataatacaaattgtaataaggtgtaaaagttctttcttcactgaagcagtaccatgttgtcctctaccccacaaatgcactactcccccgtggtctaatgtattttaaaagtcttgtaattgctattaactcagacaagtttacttaacttgttctaagcttctggtatttactacagtttactttcaatcactcaaccagctctgttatatacgttgttttccatgagaaatttgtttattagtaattaagattcttcagggataagaaaatatttgaataactaagtttgtgcataaacacattaaggtcaaatacccatgacattattgtgtgtttctgtgtactagagacaaaaacttcaaaaaaaagtttaatgaatatacgttaaattaaaaactgctttcattaaactgagataatcttccctcaatgctgaataccttcagaattcacatagaccaacgaattgtataaaatataatagccttaaaaatcttatttgtagctggcacagtggctcccacctgtaatcccagcacattggcaagccgaggtgggcagatcacctgaggtcaggagttcaagagcagcctggccaacctggtgaaaccccatctctactaaaaatagaaaaattagcagggtatggtagcacgtgcatgtagtatcagctactcgagggactgaggcaggagaattgcttgaacccgagaggcagaggtggtaatgagccaagactgagccactgcactccagccttggtgacagagcaagactctgtctcaaaaacacaaacaaacaaacaaaaaacctaattgttcccatataagtctatgttcatacaagatctgaagagtacacaacaccgtgagacaggacagacatatattttaaaagttatattcctggtttctgtaaaaataaaatagtcgaatttaagctttcaagacaagtcaacgaaaagagcaaaaaatgcaaaagtgaaactcaaaaggtcatttccccatcaagggctcatgatcactggacattcacaaagtatactgttcaaaacattagatctgaattttgatccaagtatccctttagtagcagtttcattcaaggatgtccaagaggtaaaataagacaatatcacttgctattttcagttttcttttctgagaacagcccagcattcttcttcagagaaatgaattgtcctaacttcataggctaaaggctcatgagtcatagttctaagggcattaataaaatatggtggtgcatgcttgtattctgaacttttcaggtttaaactctcatatagtaaatgctaatagatacaaaccgattaaagaaaagccctcttaatctgacattatttttctttttatttcttcatttatcagcaacaggagagtctaactaaatgtggtaaagtggtatgagggaatacaatgaacagtgtaaaatgaattaaaccagagataatcacaccaatgtgggtacaagtggaaaatataatacaaaacacaccaaagaaagtggcagaaaggtatataaagtatataaccactcacataccactttaggacacaaaaaattctgcatattatttctgagcatcacaatgtagttaaagatttcaaaaggacattgaaatgaaaaacaaccaacttatgatgttggtagcctctatgcaatcatgttttaaaaactttaacaccaaaaaggctcaaaatcaccattttaaaagactgtgtctaccagtcataaatgaatcattactttcgtcatttgtaatagtcaaagatgccacaagcgcacgcatacacacatctatatatacacctacacacacagtcttgctcattagaacatctgataggcttcagatcatcagtgtaataacactagcagcaagcctctgaagttaaaacagaaactaacactttaataagtaaagctttcctctaggtaaagatcagaactccaactagcacttaactcactggaaatatcttaagaatctcaaaattcactgctttgaatcactgacaagtataaaaattttatactgaaaacttcatgctattcaaaacattaaaacagaaacatctgacttaaagcttacatttttaaaatcttttttatgcttctaaatttgtttctattcaaatatagataccaacaataacatttatgtcaatgccttgtgttcaatattgaacaaatagaattaggaataagaataatatgagtacatccaatcattgaatgtactttatttccagtattctattaaatgtacctgctctcaatgtctatacattctttctttgtactgctcctttcacagcaggatcttccacttcagtgctaggctgaatgagttttaaaagaaaacgattcataaatcacatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtgttactgtcgagctgaattctcaggcctggctataaaaataattacttaagactataaaaataattacttcttggcttcttattttcattgcctaggacagcaacatgacagaaacacaatgaggaaaataggaatataggattcccaaaatgcacagtttacatttcagtagtgagattatgtttcaaatgcctatacttaaaatagaaaagcattgatataaccgtgaacacgtggactgatgaggagaaaagggaccattaaacagagggacaaatcaaacctgagagaatcaatgtcaaagctgatggtgaatgtacagagtattttaactccacacaccagaggcactgctgccagcacagcacaaacaaattccccttgtcttgtcactgaggaaatacgcagttgggatgacagttcaggtgaatgtgtgattcacctctcatcaaagaaagggttctacattgatcagctaggatacacacttatgaaataacagctaatcaaactactcatttttcccatgatcacatgggctactggctactgcagcacctacatttctcctatcccctcacttggccttgaattagagctccttgatccactcatgcaaggtggtccataaaacacatcaaataaaccatgtcgaataagcttctgatatcaaaatatttatcaaaaaagaaaacattgaatgaccacagacttgctggatattaatacatatttatatttcaaaatcagtgcagtatttattgaaaatgataattttggttttcatggaatgaattttatgattacttctaaaattaactaagtttggtatattatcttacactgtaaaggacttttataaaacagctatcatatcaaagaactggctgtctcaaaaaaatttcgccaaagcatctatatgcaacttaatcatatcttattcactcatgtcagtgaaacttctctccctgaggcctgacagttatcaagtgaaatgagctgctgtggtttaccccaactctagcactccctcctgtctccagtactctccacagcaataacctcttttgtgagactgggcatatgctgaagcaactggaagtgagttgtctcaagtttacttggctttaactcccaagaccccagcaaatgtctttctttcctccttttgtgtcctttcaccatccctcttcctttgaaaaaatgattatcagaactctcatcctgatgcttcccttcctaactgctttttatggatgattgtgaccacttttttcatccgtattcagcagtagtatacacctgtaatctctcttttttcatctcattttccttcccctgtggctagaatcatgctcagaaataaaaggaaattaaagctttccctggattctgttaatttttaaattgctctccagtggttctttttccagatttctctaaaggaaggctattcccttgctattcagagctgtgtccaaggaccagcacaaacatcacctgagtgctcatgagaaatgcagactccaatacctgctgagtcagaatgtgcactttccagaagctcctcaacgaattcatgacaatttgaatgtcctgttctacactggtgtgcttccatattggtttatcctaattggcctttttggcctagcctcaacttctttcctattatgtccctgaatttaatactacgttataagccataatgtttctaatgaacttttaatcaggcaaaacttctctaattaatttcttcccaataaatcacccaacactattattttcaactatgttaatatgatactatcctatgaagttacaacattttctataaaaacaaattatagccatacatggctgaccatttacggtgatgttcatctatggtagataaaacacaggtctgcatggtaaagtacctcaatccttaatgcctccccagtagcgacaatgacagcaagagaaggaaaatgttactgtaactatatgacacattttggtactggaagctcactttatcttccttcctatttctaacaccctgttcttccttcttctacagatcaatttgactttactaccctccattacatacatccactttttttatttattccatgtacactctgccctcctcattctttctttctcttttattcatttcctcttccctctctcctgacttgcctcaggtcttaagagtatgttaaaatggaactcataactcagctcctttagtggtacttccaatagaatcaactgctgacccttggttagagacaccacttatcaccatttcatttctcttttacttatgatacagttaataggacattttctttagctattaaactctattagtgctcatattttaaaagaaacattccatcaatgccttttttttttttttgagatggagtctcactctgtcacccaggctggagtgcagtggcacgatctccgctcactgcaagctccacctcccaggttcacaccatcctcctgcctcagcctcccgagttgctgggactacaggcacccgccaccatgcccggctaattttttgtgtttttagtagagatggggtttcaccatgttagccaggaaggtcttgatctcctgacctcattacccgcccacctcaggctcccaaagtgctggaattacaggcgtgagccaccgcgcctggcctccatcaaatgactttttaaataaaatacggttctcaccttttccttttccattgactattctgtttcctttttcatgagaaggtccacgtaaaggctctgacactttctcggggacacactgctaaggtaatatcaagaattagtttccatttaaaattataatgagttgcatcaagagtttcttatcaatctctttttatgaaactgggtctcactctgtcaacccagggctagaatgcaggggcctgattatggctcactgtggtctcaaactcctgacctcaagcaatcttcccacctcaacttcctgaatagctggaactacaggtgcataccatcatgtcatgctaatgtttttattgttatctttgtagagacaaggcctcattatacctcccaggctggtctcaagctcctgggctcaagcaaatcttccacttctgcctcccaaaatgttgagataagcagtttgcaccaccacacccagccctaatcaatttctttaaatcaatctcaatgttgcccaggcatggtggctcacacctgtaatctcagccctttgcaaggccaaggtgggtggattgcttgagttcaggagttggagaccagcctgggcaacataatgagaacacatctctacacaaaaaataccaaaaggagtcaggcatgatggtgtgtgcctgtagtcccagctgcttgggaagctgatgtgggaggatcacttgagcctgagaggtggatacagcagtgagccaagatcatgcaactacactgcagcatggacaacagagcaagaccctgcctccccaaaaatttcaatttaaaatgtgagaacaaagagagatacaaacaaaaaacaaacctaattagtcaatgaaatatgagcttaagccaagaaagaaaatgaaaaacatgaagtacaataaagtacatggggaaatagatctataacagagccttcggtctttcataactctgataatactaattaatatttatgctgcaattacttttttgtaagtacttctgtgatagtgtttcttactataagacattcaattagctaaatatggtcatctgccattacctgaaagaacattattataacagagagagaaaactggaactttccatcaactttccacccagaaaaagaattgatcaccagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctccagagacatggaggcatgttatctaagtgcaatggagaacatgcattgtatcatgaaccagagatggacaacagtaggatatgtacaataacaccccaacatttggacattaaacaaaatacttcagaaaaacccattgtccaagaaaagtttcacacacaaaaaaatagtttaaactgaaagaaaattttttaaaaacttaataaaatgtgggatgcagataaatcgtttcttaaaggtacatttatagatgtaatatattgaaaataaaaggcttcaatcaatgacctttaggttcttttttaagaggctaaaaaatgagcaaagtatatccaaattaagaagaaggaagatgataaagataaaaatgtaaaccaacaacatagcaaataacaaaaggtggagctaattaatatacccacaaattggttctttgaaaaaaatttttttaataaacaatggctagcaagatttatctcgaaaaaaattagagaagctacataatgtagataatgggaattaaatagaggatgtaactacagaacctacagacatcaatataattatgaaaactttaggccaatacatttgacaattaaaataacatgggaaattatttgtaaaactaattcctaaaacggatgcaaaatgaaatagaaaaagtaatagcttctctatgtattgaagaatttttttaatttaaaaagatttctataattataggctacatgctttcttaggtgaattctatcaaacatttaagaaagtacagagaatcctcaacttacagtggtttgacttgtgctcttctgacttgataatggtgctttcatctgtgtacattaatgatgagcatcaatatgaccagtttttcactatcagtatagttttcaataaatttcatgagatactgaatattttaaaatgggccttgtggtagatgattttgcccaattgtaggataatgtaagtgttctgagcaagtttaaggtaggtgaggctaagtcatgatattcagtaggttaaatatattaaatgcgttttagacttacaatattttcaatttaggatgagttcattaagacataagacaattgtaagttgaggagtatctataatatcaatcttgaacggactctttttaagaaatagaatttaagggccgggcacagtggctcacacatgtaatcccagcactttgggaggccaagatgggcagatcacctggggtcaggagtttgagaccaacctgaccagcatggagaaacccccgtctctactaaaagtacataattagcagggcatggtggcgcttacctgtaatcccagctcctcgggagacagaggcaggagaatagcttgaatctgggagacagagattgtggatagccgaaattgtgccattgcactccagcctgggcaacaagagtgaatctccgtctcaaaaaaaaaaaaaaaaaaaagaaaagaaaatttaaagggacacttcctgtcttattttatgaacccagtattgccgattccaaatcgagacaaaggcattatacaactttgatgtttatccctcataaacatagactcaaaagtccttaaaacataataaccaattgaatgtagcagtacatagaatggataataaactgtgaacaaattaaatttctagcaagattgcaaagttaatttattatttgaaagatcagtttaatcaattttattcacctggatggttacatctggcaaaactcagcaaactgtacactttaaaatagtatttattttatgtaaattatgtttcaatacaattgatttttaaaaaaaaaaacgtttcccagagtgatcaaagtggagggcagggaacagtaaacatcagtgcttatgttatagctactagaagcctcccaattccaacgacatgctttcaagcaggtctgatccttcccctggaggatacctctgacccaggggtgctacaaatgcattgcccctagttgcttctgtcaccttagtgatggaagtgacaacagggtactggagaaagaaaaggtgtacaaggttccaaatgcacattctatttccaaaggacatttgtgaagccagtggaaagcgaaaaaacaagctgctaaataagtcacaagtgtgttctcatacagttttgcgattaactaaataggacattcaacagataaaatttgttttacatagttactcctctaataggatgaacttgtggattgtgagatagggctgatataacctgttttctctctgcctcttttttttcccccaagttttgtgtgcaatacattaggaaaaatataattgggctacaaagctacaaaaatggcttcctggcagttccatgcttgtttccatgtggtgcctatgtttggcactgtgttctcatttgcagtttcctacttgattagttaatgtatgaaggacaagcctgatctctactgtgaatttttaccaaggtattctagtagaaaaatgagtatgtaatggtgctgtggaatgctaaagtgtgtaaaacattaagaatctaaaaatatgctcatttccaagttttgtcccagagcaactgtgcactctgattatatcgctactgctatttaaagttatccatttgcatgtctaaaaaatagattcatactgattgtcccattttgatctcaaaaaactcctgaatatgagagtcgtgatcaagggacgcttcatgaaatgttccaaagttaaagtgtgcaatgaaaccagatttatcatagccttatttaaaataattatttctaaaattgttattgtttaattataaacggtatcctttcaggatacttggaagatccatagcagtgtttgtattttcacagaacaagcataaattatttatgaaataataactcagatacagagattacttcctattggccttacatatgaatataaataaatacatattatgaacatgagcatacttattttataattatgtaaatgtgtgtgtaatgttatatataagttcaataaattcatgcttatacatggtttcaattcatgcttctaaaaaccactcaatgtagtcattatcatatgttaataaataatctctgaaaatgtgcttctagtagttgcacaatatcccatcataaagattgtcatgctgtttttaagtcatacttttgggtatataagttatatctgatatttttctgctacatatatactattataaatctattagtagctgattttttgtcaactcatatgattgtttcctcacaatagtacaagagttggttgtaactttatttccttccaacatttattttaggttcagcgggtacatgtgcaggtttattatatgggtaaaatgtgtgtcaatgggatttggtgtacagattaggtagtcatccaggtagtgaacgtagtatctaatagggagttttttgatcctcactctcccccccaccctccacccacagtagaccttgtgtctattgttcctttctctgtgtccatgtggactcaatgtttagcccccacttataagtgagaacatgcagtgtttgtttggttttctgttcctgcattaattcacttagaataatggtctccagctccattcatgttgctgcaaaagacatcatttcatcctattttataggtgtgtagtattccatggtgtatgtacgctgcatttttttaatccagtcttctgttaacaggcatctaagttgattccgtgtctttgctattgtgaatagtgttataatgaaaatatgcatgcatatgtctatgacagaatgatttatattcctttgggtatatacccaataatgggattgctgggttgaatggtagttctgttttaagttatttcagaaatctccaaactgctttccacaatggctgaacaaatttacattcctgatgaaactggagagttccctgactccccttggcaggatgtgcaacaggggtgtggcttgtctggccaccgtgtttgctgtcaaaccccttactgggcaggggagcatgcagacaggcagttgcaataggcagggcaagtggccatggtactgtcttaggggtgggttcctgcgactcccacagcccaagtgggcatgtgttacagtgcactcttttagctttgccatccacagacggtttaagtgttaacctgttcagtgccctcttggtacccagttccttgtccagcatccagaaagaattaagttgcacacagacttgaggatggtgaatgtgggggctttattgagtggtggaggtggcagtcaatgggatggatggggagctggaaaggggatggaatgggaagatgatcttccctgggagctttgccatccagaggctgatctctccaaccactgccagccaaactcctcttggcattcagatgctccttctcttctttctgccacatcattctgcaattctgctcttctgttcatctcctcatctgcttgtctgcttctggagcctggggtctggggcatatatgggtacaggacaggggttgcatggtgagctgaaagacaacttttgggtgcaaaagcaggaatgcctgttcccatttagggccatgggtttccaggcttgtgggcagggctttgccagggaaccactctcttctacccagtatttccctgtctcctttctatatcaccaccagcagtgtataagcattcccttttttccacaaactcggcaccgtctgttatattttgattttttaataatagccattctggccggtgtgatatggtatctcatggttctgattttctgatgattagtgatgttgagtattttttcatatggttgtttgccatacatacgttgtcttttgaaaatagaatccacagatggcttaagtgttaacccgttcagtgccctcttggtacccaagtccttgtccagcatccagaaagaagttgcacatggacttgaggatggtgaatgtgggggctcatgttctttgcctatttgtagtgggtttgttttttgcttattgattctttatacatgctaagtattagacctttttcagatatgtaatttgaaaatattttcttctgttctgtagggtgttctctgttgatagtttcttttgctgtgctgaagctctttagtttcgttaggtcccactcgtcaattcttcttgttgcaattgctttggaatcttcatcatgaaatatttgcctgcgtctatgtccagaatgatatttcctaagttttcttctagggtttatatagttttgggtcttacataagtccttcatccatcttgagttgatttttgtatatggtgaaaggaagggagtgtacatgcccctgtgatattgttcctaatatccaggttgggagaggatattatactcaatagtgcaggaagtgtcgaccaccctgaatattgcttttactatccggggagagagggtgatattactcccaatatcatcctctccccccacaccctgcatagtacaagcaatatcaaagggggtctgtgcaacacgtgcaatattgggagtaatatcctcccccaacatggatattagaaacagtatcacaaggggttgtacaccacctgtgatattggggagtactatcattttctttccccatggatatgtagaacaatatcacaaaggtggtgtacaacccctgctatattgggagtaatactgtactttcctcacctagatattaggaacaatatcacggggggttatacaccactgcaacattgggagtaatatcatcctttccctccctggatattaggaacaatacctcatgggtgtgtacaccctgttccatattgggattaatattttctcccttgctggacataaggaacaatataacggggggtatacactccttatgatattgccagtaatattatagactccccaaagggatattagaaagagtatcagagaggggtgtacatcccctgcgatattgggaataatattctttctttccctggatattaggaataatatcacaaaggggttgtataccccccgtgacattttaattaatatcatctttcccactgaatattaggaacaaattcccagggggtggtacaccatctgcaatatggacagctatatcattgtctctcccccgaatataaggaacaatatcacaagggggttgtacaacccctgtgatattgggagtaactttataccctttccacatggatattgggaacaatatcacagggtgggtgtacacccactgcgatattgggagtaatatcatcctctaccccctgggtattatgaacaatatcatggggagggggtgtatgccctctctgatattgggagtaatatcatcctgtcccctctggatattaggaatgatatcacagcggggctgtaccttttctgcactattgggagtggtatcaccctctccgcctatggatattaggaacaatatcacaaagggggtgtacacatcctgtgatattgagagtaatattgtccactcttccctgggatattaggaacaatatcacaggcagagtgtacaccccctgctattttacctgtaatattattctctcccaacctggatattaggaataatataaaaggaggggtgtacaccacctgtgatattgggagtaatatcattctctccccctatggatattgagaacaatatcacaggggcggtttacacctcctgcgccatttagagtaatatcatccttttcccccatggatattaggaacgatatcgcatgggaagtgtacatccccgccatattgggagtaatattttctcccttgctggacattaggaacaatatcacggtaatgcacacaccctgcgatattgccagtaatatcgtagtctcctcccaggatattaggaacaatatcacaagtggggtgtacatgccctgtgatattggaagtaatatcatcgactccccccacggatattagtaacaataacagaaggggtgtacaccccttgcgatatttatagtactatcgtcctataccccctggatattaggaacaataccacgggggttgtatacccactgtgatattgggagtaatttcatcctctaccccttggatgttaggagcagtatcacaaggggggtgtgcaccctctgtgatattaaaaataataccattctctccttctctggatactaggaataatatcacagtgctggtgtgcaccctttacactatttggagcaatatcaccctctccccaacttgatattagagacaatatcatggggggtggcgtgtaacaccctgcactgttgggagtactatcatctagtcttcccctggatataagaaacagtatcacagaaggggtctacacctcctgagattttgggagtaatatcatcctctccaaatctggatattaagaacagtataatggggtgtggggagtaatatggtgggagtaatacaatcctcctccccacttgatattaggaacaatatcgcaaaacgtgtgtacacccactgtgacatttggagtaatatcaacatttccccacctggtatcacggggagagtgtacactccttacgatattggaagtatcattgtctctcactctcgatattaggaaaaatagcacagggtgtgtatacacttcctgtgattttgggaagaacatcatacccttctgtctttgatattaggaacaatatcacagagggggtttacaacttctgtgatattataatattctttcttcccatggatattaggaatgatatcccggggggcttgttgtacaccccctgtgatacggacagtaatatcattgtccttccccctacatattagaaacaatatcacaagggtggtatacatcccctggatattagaaactatcacaggggggctgtacaacctctttgatactgtgagtaataccattgtctcccctcctgggtattaataacaatatcatagggtgggtgtacaccccctgcaatattgggaataatatcatcctctcttccccgggatattaggaacggtatcacaggtggggtttacaccccctgcaattttgtcagtaatattacttctggatgttattgaatatatcacagtgggggtgtacaccccctgtgatatggggagtaatagcatgctctttcccactggatactacaaacaatatcgcagattgtgtacaacctcctgtgatattgttcacaatatttagggaaggagaggatgatattactccacatatcgcagggagtgttacatcccctgtaatattgttcataatatttagaagacgacaggatgatattactcccaatatagtaggaagtatacactcccctgtgatactgttcataatttttaggggattagaggatgatattacttccaatatcacagggagtgtatactggtgatattgtttataattttcagtggattagaagatattattccgaatatcacaggggttgtacatccccaagtgatattgttaatatccagtgggaaagaggatgatattactccccatatcacaggggatgtaaacccgtttgtggtattgtcacttacatccgggggggagaggatgatattactctgcatatcatagagggtgcacacggctgtaatgttgtccaaaataacatccagaggggaagagaatattattcccatgtttcagaaggtgtacacacccctgtgatagtctctgtaacatttagggaaggaggggatgatactactccagatattgcagggggtgtacacccccctgtgatattgttcgtaacttttagggggaagaggatgatattactccccatatcgaagggattgtacatctccctatatattgtccataacatccagggcaggagaggatattactactccccatatcacagggggtggacaaccccctctaaatatgtctaacatccaggcggggacaggaggatatttttccccataacccagagaaagtaaacctcctgtgatattgtccataacatccagtggggagaggatgatatcactccccatattgcagggggtgcatactccactctgatattggccgtaatatccggggaggtgaagtatgaagtcactacacatatcgcagggattattagtatcagattgtttgaagggctcacagtaagggtagtagtagggcgaattctaactcaaatggggaaatgtgatggctactagaaagaattttatggagaagggaatgtgggcagaggatagagggtcaaatctgcattcataagggctagatttttctatatatatttattttatacatatatatatatttttctctctctctacatatatatattaagttgtgggagccaaaatgtaataattattagtaacagggctaatagggtgttgattactagggttaatgttaggtgaattactgtttttcggatgctatcaaaactttggaaatcatggtactatttacactaaaagagtaagatcctcatcaataaatagaaacatacaagaatagtcatactacatctacaaagtgttgatatcaggcagcggcttcaaaggcaaagtgacgactagatgtaaagtggtattttaattggcggagaaggcagattgaggaacgttgatccaataatgacgtgaattctgtgaaagcctgtagctataaaaaaatgttgagccataaataccatcagaaatagcaaagggagctttgaagtattctgagacttgtaggagggtgaagtaaatatctaatataattgtaacaggtagtgcttggcttgcatgtttttgattattttttgttaggctgtgatgggctcaagtaattgaaactcctgatgcaagtaatacagatggattcaggagaggtacttccagggggtcaaggggagaaatacctgttgggggtcaatgccctcctaattctggagtaggggctaagctagaatggtagaatgctcaaaagaatccagcgaagaggaatatttctgagataataaataggactgtcccatattggaggcctttttgaacagttgttgtatggtgaccctgaaatgtactttctcagatacagaacacccttggtcaattgaatacagatcaatcactttaagtaagctaagtccttactaaattgatgaggcttaaacccatgaaaacttaacagctaaactccctagtcaactggtttgaatctacttctccagccactgggggaaaaaaggtgagagaagcaggattgaagctgcttctttgaatttacaattcaacatgaaaatcaccttgggactggtaaaaacaggcgttgacctctgtttttagatgtacagtctaatgccctactcagtcattttacccttttttctcacttcatttatgttggctgacagttgactaatctcaaccaaccataaagatatcgggacattatatttattatttggcacatgagcagggatagtcagtacagctttaagccttattcgagctgaactctactagatgatcaaatttatgtcattgttatagcctatgcatttgtcataattttctttatagtaatactataattggaggtcttggcaactgattagtcccccgataattggcgcccccgatatagcatttctctgcataaataatatgagcttctgactcctcccaccctccttcctattattacttgcatccactatagtagaagccggcactggaaccggctgaacagtctctcctcccttagcaggaaacctaacacatgcaggcgcctctgtaggtttcactatcttttcactccacttgacaggtgtttcttctacttcaggggctattaactttattaccacaattgttaatataaaacccccagccatgtcccaatatcacacacccctcttcatctgattagtcctaattacagcagttcttctactcctttgtctccgagtcctagccgccagcatcactatattgttaactgactgcaatcttaatactatttttttctacctggctggcggaggtgatcctatcttatttcagcatttattcagattctttggtcaccctgaagtctacatcctcatcccactgggctttgggataatttcccacgtcgtaacatactattctggaaaagaaccattcaggtatatgggcctagtgtgagctataggatcagttggatccttacggtttattgtatgggcccaccgtatatttacggtagggatagatgtggatacatgagcctgcttcacctctgctattataattattgctattcctactagcatcaaagtttttagctgactagctagctacacttcacggcggtaatatcaaatgatcccccgcaatgctgtgagcccggggatttgttttcctttttacagtaggaggcctaaccggcattgtattggccaaggcttatattatggttcattcatatatttagaaacctgaaagtttctaaataagttgtaaaaaagttgtaaaaaaaccccagctgaaataactacgaaggtgcctttaatattctgaagacaaaatagctaagatccaaactgggagtagataccccgctatgcttaactctaaactcaaatagttagatcaaaaaaactgttcgccagaacactacaagcaacagcttaaaactcaaaggacttggcggtgctttatatccctctaaaggagcctgttctataatcgataaaccccaatttacctcaccacctcttgcccagcctaaatacccccatcttcagcaaaccctggaaaggctgcagagtaagcacaagtatctacacaaaaactttaggtcaaggtgtagcccatgaggtggcaagaaatgggaacgttttctacatccagaaaaatgtcgcgacaaccgttatgaaatctaagggctcaaggaggatttagcaataaattgagagcagagtgtttaattgaataaggccatgaagcatgcacacaccgcccatcaccctcctcaaatatattctagaaactcattctatacccccctgtgatattgtccataatatccagggagggagagaatgatttgattttttttttttttttgagacagagccttgctctgtcacccgggttggagtgcagtggcctgatcttggcacactgcaagcaccgcctcccaggttcacaccattctcctgcctcagcctccctagtagctgggactacaggcgcccgccaccgcgcctggctaattttttgtatttttagtagagacggggtttcaccatgttagccaggatggtctcgatctcctgacctcgtgatctgcccgccttggcttcccaaagtgctgggattacaggtgtgagccaccgctcctggccagagagaatgattttactccccatatcgcaggggatttacattcccctgcattatttctcgtaatacccagggggaagatgaagatgttactccccatatagcatgggagaacaattccctgcgatattgttcataatatctctggggggaaagaactgtatttctccttttatcacaggaagtgtacacccccttgtgatattgtttataatatctagtgggggggaggatgatgctactccccatattgcagggggtgtacaaccccctagaatattgttcataatatccacgcggggaggagatgatgttactacccatatcgcaagggtgtactgccccctgccatattgtttgtaatatccaggctgggaaaggatgatattactccctgtatcacaggggatgtacacacccctgtgatattattagtaatatccatgggggagataatactacttccaataccataaacaccctgtgtgtacaccctctgtgatattttttgtaatatctagggtgggagaggagtatattactccctataaggcagagtgtgtttacacccctctgtgatattgttcataatatccactgggggatatgatgttactcccaatatcataaacacctcacatgtacaccgtctgtgatattatttgtaatatccagtgggggagaggatgatattactttccacatcgcagtgggtttacacccctctgtgatacagtttgtaatatctagagggggagagtgttatattactcctcatatctcaggacatgtacacccccctgtgatattgtttgtaatattgttcccaatatccttttcccccatggatataggaacagtattgcataggacgtgtacaccccctgccatattggaagtagtagtgttttctccctcactggacattaggaaaaataccatgggggttgcacaccccctgtgatattgacagtaatgtaatccactatcccctaaatataggaacaatatcacaatggggatgtacacacttggcgatattgaaagtgatatgatcctctccccacctggatattaggaacaatatcacagaaggggtgtacaccccctgcgatattgacagtaatatcctctcccacccccggatattaggagcaatatcacagaagggttgtaaactccctgcgatattgacagtaatatcctctcccccccggatattaggaacaatatcacagaagaggtgtacacccactgtgatattgacagtaatttcctcttccccccccccccccggatattaggaacaataccacggggggtgtacacaccctgctatattgacagtaatatcatcctctcccccccagatattagtaacattatcactgaagggttctacaccccctgtgatagtgacagtaatatcctctccgccccccagatattaggaacaataccacgggaggatgtacaccccctgtgacaatgacagtaatatcaacctctccccccaccccggatattaggaagaataccacggggggtgcacaccccctgtgatattgggagtaatatcacccactatcccctaaatattaggaaaaatatcacaaggcggggagtacaccctctgcgatattgggagtaatgtcatcctttccctgcccctgcatactaggaataatatcacaggggatgtacacccccataagctattgggagtaacatcactctttcttcccatggatattaggaacaatatcacagaagtggtgtacacacgctgcactgtatagaataaagcaggcggaggaagatgggataatcttgctaggtgaagcttctggctctctttttttcttcttcccgtgcaggacacttgcttcccttcttcctgccctcggacatgagactccaggttcttatgcctttggactctcggacttgcaccagcggctttcccgaggctctcaggccctcggcctcatactgaagactgcactgcgggttttcctggttttgaggcttttggacttggactgagccactactagcttctctctttccctacctggcagacagcctattgtgggactgccttctaaccgtgtgaaccaattctctctcgtaaactcccttatacatatacgtgtatcttgttggttctgtacctctggagaaccctgactcatacattttgtttattttttctccattgccctttcctctgcttctaggcttacctagaccaccaccattctttccccctttctaaagtaaaagctgtttttttctcactaagtgcatggtattctgcccgttttccatggcttccctcagccctgctctgtttattcttgctatcttaagaggaaatccctgcctcttccgtggcttttcccacttggtctacatactggtttctgttgttctcagagacacactgagacctttcacatctcactgtcacttcttggaagggctctctacctcgcctgcctgctgagcaacctcttggggagacgcgggccctcttgagtcactgaacttgagctatatggtgttggtatgctaatttatcttcttagaccacttaccacttctttaacttcaaaagagaagaataagtattattttccatggttgatatgaagagtagaaataacttatacaaaatgcattgcagttaagtgataataaatggccgtgaatgcccttattaatgttattctatcagtctcggctcagataccatctgctctgtaagctctgctctgaatcatatctgcttcttctctgggttccttgtgctctgttcttaactactttaaagcagtaattgttctgattctaattagtgatccttcccaataaaattttaattttgtagatctctttcccctacccctgtcccagcctaaccagtgttttcttacttttttgtgtacaggctacatcactggtcttttatttgtggctaaataaatgttgtgttagaagagtaaagagttcccagttacatgggatctatagttctacaaaatgaatgtatacggccgggcgcggtggctcacgcctgtaatcccagcactttgggaggccgaggcgggcggatcacgaggtcaggagatcgaaaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaatgaatgatacataatccatgtaaatatttcacttattttaaaacaattttttaatttttaaattaaatttaatttgtgcatgtgtgagagaccagagtgagaccagagatggcagcggtgaggggcggtggtctcaccatgttgcccaggctggtcttgaactccccttcaagtgcccccctcctcacctggcccccctcaccttgcctcctccccctcactcctatgccagcccctgccattccctacgccctctgttgaccgcaagactcaacaagtgacttgctgagcaaaccctgctgagaagagatctgtttagggacacaggaggccaagtacacaaaaaagcaaaagaactagcatgcctttttcaatggatgtctattttacagggctggcttcagattattgttatagctttaaataaaaggaccgttttgtcatctcggcccatggcctacattatttctttactgtccattgccctgggctcttgactaataatttaacagcaatttttttaaaaattttaaatcatgattcattgcattgctgtaagagtaattagaggtaaattagggcttgaaactgcctgtagtgggttactttctgagatcttaacataattatcaggtgagagggtgaagttttaattagcgctaagtgggatagaaattcaatgcactgaaactgcagtgtccaattcagtaggcactagccacctgtaactgttgagcacttgaaatcctggctagtcctaattgagatgtgttgtgttatatatactggattttgtcattggagtgggaagaacagcgtagaatatctgcttgataattttttatattgattacatgttaaaattattactatgattactatttgggacatactgagttaagtatatttaaaattaatttcaccttttaatggggtttactagtacatttaaaattacatatgtggctcacatatttattggacagcacggctctagaagtttaggaagaaataagaaaaatattgagaataggtagcgacagtaggaagtttgacctcctgtaagactgattccaataaaactaataggtgatagttttaattggctttttcctactagaaaaagtaagtgtactttacgtgtctctttgttctccctctttccccttcaatttagtggttagcgtgtatttactatatcaggcttaatattcactaagcagtgttaagaagacttaggtaaatgattccctgatgaacacacttgattttcaaagcactttcctaacccatttttaattggaatagagtcaaaggtagatggcttattagtagtcatctcatttaaacctcatggaattttcctgctaaatctcaaagtaaacaatttgttataggctgttttgtcaagtgcatggaagggacagcataagacatgtggtacttcatttcaaaattgcttgagatggttttcattataatcatacattatttgcttctggttttccggaaaagccagctaaacctgtggttcatttagatataaatgaaatatcttcaaaggattgctcaaagtgacttatgcaacttgaatatatatttttttctgtagggtgtttattccaaattatctggccatttgtggcaatttgcagttttttagaaaacaccaaatatttttcaagttagagatgttttaataaaaacagtcatattgaactggaagcagccaaataaaatggccctttatttcacagttgagaatttgaaattggaaggtaattaacatatgtaaggatgatgtatttgctgcctggcttataggaatgagccaaggtgttttttgagggatgttgttgctgtgtatgtcccacctattttgcttccttaatgaacaatgcaagtttgagacagaaatatttgagaacatttttatcagttgcgacattttgatagtgaacattttatatcttctgtcaacttaaaatgtttgcatcttctgtctgcttaaaatgtttaatttgttatagccaaataatttggctataattgattttaatttatcaaattaaattgctttttttccctttagactttcttcagtcacatctgaataaatcacttagaagtaagctagatgtaatataatgaaatgcttaaaagggctgtttatcttcatattacacttacagtgattttctgttgtacccattatattctacctgcagctagttgaggtaaagagagggcatttaactgtcatgggaacctgtgaggagactgtagaaatctggaaagtctcttgggtctttgagggattttgggatgcagagagtggggctgggatctctggctaggttggagccagcctgcatttgtatctttatcttggaagcaaacttagaatgcagagatagatgtggcctggatgctgctaattctagccaaccactaaatcttaaggtgggagagatgcaggctttggctgggtgctaagctgctgtagctggttgaatgtagaggtcactattttttctgaatacttgtaagtaaattaaatcattctctactcctgtatgcctgccaaccaaatgggaaatcgctatagaaaagatggtttaaattttagtctttgaagtggttaatgcacgtttctggaatcaagatttaatgtggacttggattggatattgaatattttttatttgtctacttttctctccatagggagcttatagcttcattgcactgtgtgtggcatttgggtcctgtttggcagcaatgactgcctttctatttagtgtctgtgtgctatgaagattgcacacaggggtccagatgcatcctgttttgagaatgttaatggatacaccagctgctgctttggatttcacccattggcggtttctataaaaactttagacacagtgagccactcttctcagggaatggtggaaaccctcccaattccaatttcctaaacaccagccaagggccagccttgcatgcaggcctttctaaggatggcagtctcttgcctgttatatgaaatcttttctgcacactttgtatagccccaacttaatttttggtgttgttttaaaatttcattttaataacataatattataagataaggtaacttggtactaatttctgttgtatgatccatcttaagttgcagcgctggttacttttttgactttcagtgacgaacagctatttgtacataagttaccatagcaatgttaggtaattataatctgtcctatttatctcatttacctttcagtaaaattgttaaataagcaaaataatttctgagttaaaattagaataaaaattgtcttttatttggattacatgaataatctagttttcatattgtgctaaagccctgcttagaattatgaaataagataaaatattcaatcatttttatcaatattttcttacctaagcatgcaattaaatttatttattttatatattttatatacttcaatttgagaaataatgaccacgtgttgttactttggtcttcaatgatctctaatttttagggtcaccgtgtcttgcttaaatatatcatagtaacaggttcagtgaatatctttatttttaattttatttacttatttttttttgagacagagttttgctcttgttgaccaggctgcagtgcaatgacacaatcttggatcattgcaacctccacctcccaggttcaaatgattctcctgcctcagcctcccaggtacctggaactacaggcatgcaccatcatgcccagctaattttttatattcagtagagatgaggttttaccatgttagtcaggctggtctcgaactcctgacctcaggtgatccacccacctcagcctctcaaagtgctgggattacagacatgagccactgcccccagccatcttttttatttatttattttaattgttgttctggagatcctgggatgcatagacagtgaatatcttttttgttttttgagacagaatctcactctgtctcccaggctgcagtgcagtggtgcgatcttggttaactgcaacctctgctttctaggctcaagcgattctcctgcctcagcctcccaggtagctgaaattacaggtgccagctaccatgcccagctaatttttgtatttttattagagacgaggttttgccatgttgaccaggctggtcttgaactcctgacctcaggtgatccacccacttttgcctcccaaagtgctgagattacaggcatgagccactgagcccagctgaatattttttttaaatcaataaccttatttcttagagtagttttaggttcacagcaaaattgagaggaaggtacagagatttctcatatatcccatgcctcccacacacgcatagcctcccccattattaatattttccaccagagagtggtccatttgttacaactgatgaacttacattgacataatcacttgaagttcatagtttacatcaggcctcactcttgatgctgtacattctgtgaatttggacaaatgtataatgacatgacatgtatctattactgtaatattatcgacagaacagtttcaccgccctaaaaattctctgtgctatgcctgttcatctctccctttctccctagcaactcgtgacaacaattgatgtttactctgtcttcatagttttacttttttcagaagagtcatatagttggaataagaagaatggatatctttttgagtagttaaaaaattaaagctccatggcagttgaatgtagtcatttaagatgttctttgtccttttgtttttcttttgcttctttatcattgtaaagaatgatgtattctgttgagatatgatttacatacttagaaaacatgatttgtatagatatgtggcacataatagaaagggttgaggaaaaggacaccacgccgtactacacagcacaacctggagcatcttgctctgtgaggtgggtccagatagactttttagcaatggaaggggacaagtgcaaagggttgtgctttataaaactggaatcacaaagtctttcatacttaccttcggttggaaataagaccaggcagtgaatgctattaggtaaatacataagttcctcactgatcctcttcctttgagggatgaggttgacaacagcctgtattatgatgacatgactcacctacaactagattctgtcatgagagatgacaagggagttttgctttatgcgaggtgcaaaagtttttttctcctactagggagatgggcaagcattagaacattctggtagtaaaagggcattgatagttttctttctatatattttttcacatcagataatattgcccggcagcctgccatacctcccgagtgtttattcagcttctctctgaatgtggataagctcttaacggagtgatctttccagtggttctttcgtgggaggtaaaatggcaggtgaatttgggccttgttatacgtaggccagagcaaatagctacaactaaggaaaccacccagcaccttacccagaagagtattagccagagtaacacactgatctctcttgagatcttctccactggtggctggaaagtctttgcaaggattcctgtttctggtctgattcctatgttttgttggtttctggcgatagcatgtttaattctaaactaaacagtttgaactgaagagctagagaggctgtgttgtgttataacaaaataagtgcagtaactacatcttaactgtgggagatacattccaagacccccagtgcatgcatgaaaccatgaagagtactgaatcacaagctgtttttccctatacatacatatctatgagaaagtttaatttataaattaaattaaatctgatgttatctgtagatagggtgtgagaattgaattgtgtcatcagcaggaatgattgcttgtttgttggtggggaaaaactctccacacatttggtcacagaagccttctttgttgatgattgttgctgtggtgtgacaacagagaaaaacgtgtcaagtatgtctttctgcgcatatagtggataaggggtactagtgtatactctgttgtaatggcccctcatattttggtccagaaatcatgctctttgacactgttgactcatcacacctgttctgctaacaataccatttttactcaatctcataggctttggctaggatgacttgtatactgcagctcacttgtagataccaaattttaataaatttattcttctttgcatctaataaacacagagggaagagttcttactgcattaattacctaccaatacgtataatgaatgttaattctaataagatcccaggcatgctcccaaaggaatgctttgtaacaaagcgtcagtcttatgctttaaaaaaccaaaccaaaccaaaacaacaacaacaacaacaacaacaacaaacaggatgtaaagcatacacacaagtgtgcacaatttttttatgaaggtagagtcttattatgtttcccaagctggtctcaaacttctgagctcctcaagtgatcctcctgcctcatcctctcaagtagtttggattagaggcatgcatcactgtgcattcttatgattttaatattctgtacatttattattgatttaaaatgcattttacctttttctttaatagatgttggaattcctgatgaatctgcagtcaggtaagatttcatagatttaaaaaattatgttaactaagaaaatatagatggaagaaactaatatctgttgagtgttgtattctgggctagacatcctaatatgttctatgcatttatcatctcataaagccatcataacatctgtgttcctataacctactgttaaataaacaactatggattagagctgattaattgcctcatgatcccatagttaacaaagtagctggcctacagtttgaccatcagcctacctgccttccaaatcctttctcttgctcctcagcatagattgatagatatctgtgcagtccttggatcaaagtataggtctgaatcagatcaatcggattcattaatttgattaacttctaaattaatgagagtttaaataccttgaactctcatttaagtttattgttagaatgtggttagtcctaataaatttgacgatttcagtggtaaccagtatcttatttttaccttcaaaggctctagggcagatctgacttagctttggccataggactgtaagttttaccaaagcaagtttaggcaagtcttagagacaaattatttgacttcccagtttggttttccatttaggcaagtatttctgcttacttccataatacattttttagtcttgttgctttttccatgacttttatataatcttgtcttcattttttaaaactttcttctctgtttttcttggtgtttcttttgttctattatttttttcaaactctgctgcctatgtattccaagtttttctatagacagaatcaagaggacatagaattacagaattttaaggaatcttggaatgaattaaaataccttctagtatttttatctgcattgaacattctggtcaagtgattctctagatagagaatgtgaggctcaaagagattaggaagcttttttttttagacataggaattggcagaaatgagatttgaactcatggtaaagcccagtactcttgcttctttttatgtcctattggcgtgtgttttaataatacaaacgggagtgagcctgtggatagaatgagaatggaattagctggtgaacccaatggaagtagataagaatggaatgagcaggggaagtccaagtttgaagataaacaacactggactggataggagtacggactcttctacaagagatcaaagtattggggtttatgacaagtttgataaagataaattataaaaatgaaggacacaagatgttgggaattatctacaaaggcacattaaaatagaaggttcaagggagctctaaaaattttgctgctttttttttttaaatcaaggactgacaaacttgaagatttttactgaaagatgccaaaacattttgagacactgggaagaatgtctacagcagataaaaatgtggtgtcatctacttccatcctgacttacaaaggggtggcttagagcccctggagtactaaggggctggaaattgctgaactacatagatgtgtggcacaggacaggtgtctcctcacctctgcctcttttcacggttcactgatgtccttcccatgtccatgtgggctgggtcaggggcatgattagctggcaaatcagtcatggagttcagttgggtagttggtagtgtgtatagctggtggcaggtgatggagactccagttagcttgtttttcaggagcagggatatagagagctcctactcctggtcatttgaggccattctttcaggaatctgtgctttcatacactgaagatttgaagattggagacttctgtggaaccctgcagaagtagaatctggaagtgggtgtccataggaagaaatatacttagatagtacttagggaaatagaggtacaactatcatgactctgtttctttcctcgcagtctctctccttgggtgtctgagtgcctatgaaaatttttaagggcttgctagtttatgtggacctgaataaggtaggacctatagagtgaaaataatgggattttataattgttaatattttaatatttctgggaaaagtattctcagtaagaacatacacctttgctatttgacttctgtacatttagctttcatacatttcaaatattgtgggggctttcctgtaccaatttagggtaaaggaaagcaataggaccttcctaagttggatccatgctgaggaatcaagactaccattttgaagtgatgtagattagtcttttatccagagacagatcacagaaaagagacagtggatctttctaccttgttttaggtcatcagttttattccagtttagggaacaaaatttatgtcatccattaattgaattttaagttcagcttcaggacagataatttgtgagggcacattattgtcaggctctgccaatatattgactgtcactatttgttataaacctcaaggtaagttttcattgaatattttatagatttagacaggtggaggcagaaataggtaactaaaatctatttttagaacagaggacatattttaattatatcaagaatcataatttaatatatagatcactgacctttccccagattatgttttcctttttttgagggggaagctggatataaactggcagttaaaaaaattgtaaagaaatcaacttgctcattttcattgtgtatttttgctctcaagcattttgcataaactgtgtgtggattcattgcctacattggatgatgaagacttgagtgttgctactaaggtaaagtggtctcttgtaaaattaatcttctcactctgagtgtagttttgcatagtatttacttttcaaatttagcagtggtttacctatcattgttttatggtggtaatggaaagctggtcagagaaaaacatacacatggctagttgattcaaaaaatgtgtttaactttggtaactaataaagattggtaagtactgtgacagggtgggagctgaaaaataaatgaactggaaaacaagtagtcacaggaaaatcacattaggaaatgctttctccaatagaggaaatatgaaatttggttaaagtttatttggataaatactactactttgacttttaaatcatacgagtgtgactttcttaatatttattcctgtataaatcttcagtggatcaaattgtttgcagtaatcatggaatcctcctggtaatttttagtggcagaaatgttcagcacatagcatatagcttttgttcttggaaacttatcattttggtgtcatatagtttttaggagagattgtttctctacttatattattggttctgtagtgagactaaaaaagtattaaaaattgtagaaaaatagctgagtttggtggtgtacacctgtagtctctgctacttgggagtttgagacagtaagattgcttgaacacaggagtttgagaacagcctgggcaacattgtatctgatttaaaaatataaattgtggaaatgtagaaatttaaatttatgttctcaagatttgtattgcaaagggatttttatgtgatttatgagttgtccatgaagagtttatataaaacacttcatctaattgaataacttgtattttcctgcaaataaccagttctagaagcagagactcttaataccaatatggtaagtctttatcatcataattttgtcattgtagtttatttaaaatatttacttggccaggcgtggtggctcacacctgtaatcccagcacttttggaggccgaggtgggtagatcacctgaggtcaggagttcaagatcagcctggccaacatggtgagaccctgtctctaaaaaaaaaaaaaaaaaaaaaaaagcacaaaaattatccaggcatgatagtgcatgcctgtaatcccagttgctcaggaggccaaggcaggggaatcgcttgaacccaggaggcaaagattgcagtgagccaagattgcaccattgcactgtaggctgggtgacagagcaagactacatcttaaaaaataaaataaaataaaataaccactcaaagtccttatatcatattctgaaagtttgaatgtcagaaggttttctatttagttttttaaatgatcattggaagctcctgcataccataagctactggaggtcagtaaacatatttgtgtgtatcctggagtacctagaatacagtcttccatgtaagaagcattttacttgttgttttttgagatggggtttcactctgtcacccaggctggagggcactggtgagatcttggctcactccgatctccatttcctaggctcaggtgatcctcacacctcagccatccaagtagttgaaacaatagagctatgacaccatagacctgtgtcaccatgctgggctgagttttgtagagatagggttttgccttgttgcccaggctcttctttaactgttgggctcaggtgttctgctcgcctcagcctctcaaagtgctggggttacagacatgagacattcagccttaatagttgtttaatctgaataaataaacaaatgaatttttatataatggaatgttataagtaatataataaacctaatgtatctaatcattaaatattgtatttaaaatattgcttacattgtattattttttaatatttaagggtgtataagttttgacatgttatgttgagaaattatgccataattaaaaaggaaataaaagagaaataggtcatcggtagcaaagagggttacaatatattttctagtatcattcaactggaatcttaacattgagattttagattaacatttcttaagctttttgttagacccaactcatgttccattaaatatactgtttcaagccatacattactctttattattattattatactttaagttctagggtacatgtgcacaacgtgcaggtttgttaaatatgtatacatgtgccatgttggtgtgctgcacccattaactcgtcatttatattaggtatatctcctaatgctattcctcccctctccccccaccccatgacaggccctggtgtgtgatgttccccatcctgtgtccaagtgttctcattgttcagttcccacctatgagtgagaacatgtggtgtttggttttctgtccttgcaacagtttgctcagaatgatggtttccagcttcatccatgtccctacaaaggacatgaactcatcatttttttatgctgcatagtattccatggtgtgtaagtgccacattttcttaatccagtctatcattgatgggcatatgggttggttccaagtctttgctattgtgaatagtgccacaataaacatacatgtgcatgtgtctttatagcagcatgatttataatcctttgcatatatatccagtaatgggatggctggatcaaatggtatttctaattcttgatccttgaggaatctccacactgtcttccacaatggttgaactagtttacagtcccaccaacagtgtaaaagtgttcctatttctccacatcctctccagcacctgttgattcctgactttttaatgattgccattctaactggtgtgaaatgatatctcatagtagtttcgatttgcatttctctgatggccagtgatgatgagcattttttcatgtgtctgccatacattactctttagaattctggtgaccaattctttttctgggtggaaagttgatggaaagttccagttttctctctctgttataataatgttctttcaggtaatggtagatgaccatatttagctaattgaatgtcttatagtaagaaacactatcacagaagtacttacaaaaaactaattgcagcataaatattaattagtattatcagagttatgaaagaccgaaggctctgttatagatctatttccccatgtactttattatacttcatgtttttcgttttctttcttggcttaagctcatatttcattgactaattaggcttgttttttgtttgtatctctctttgttctcacattttaaattgaaatttttggggaggcagggtcttgctctgttgtccatgctgcagtgtagtggcatgatcttggctcactgctgtatccacctctcaggctcaagtgatcctcccacatcagcttcccaagcagctgggactacaggcacacaccatcatgcctgactccttttggtattttttgtgtagagatgtgttctcattatgttgcccaggctggtctccaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttgggaggcagaagtggaagatttgcttgagcccaggagcttgagaccagcctgggaggtataatgaggccttgtctctacaaagataacaataaaaacattagcatgacatgatggtatgcacctgtagttccagctatccaggaagttgaggtgggaagattgcttgaggtctggagtttgagaccacagtgagccataatcaggcccctgcattctagccctgggttgacagagtgagacccagtttcataaaaagagattgataagaaactcttgatgcaactcattataattttaaatggaaactaattcttgatattaccttagcagtgtgtccccgagaaagtgtcagagcctttacgtggaccttctcatgaaaaaggaaacagaatagtcaatggaaaaggaaaaggtgagaaccgtattttatttaaaaagtcatttgatggagaccaggcgcggtggctcacgcctgtaattccagcactttgggagcccaaggtgggcgggtaatgaggtcaggagatcaagaccatcctggctaacatggtgaaaccccatctctactaaaaacacaaaaaattagccgggcatggtggcgggtgcctgtagtcccagcaactcgggaggctgaggcaggaggatggtgtgcacctaggaggtggagcttgcagtgagcggagatcgtgccactgcactccagcctgggtgacagagtgagactccatctcaaaaaaaaaaaggcattgatggaatgtttcttttaaaatatgagcactaatagagtttaatagctaaagaaaatgtcctattaactgtatcataagtaaaagagaaatgaaatggtgataagtggtgtctctaaccaagggtcagcagttgattctattggaagtaccactaaaggagctgagttatgagttccattttaacatactctaagacctgaggcaagtcaggagagagggaagaggaaatgaataaaagagaaagaaagaatgaggagggaagagtgtacatggaataaataaaaaagagtggatgtatgtaatggagggtagtaaagtcaaattgatctgtagaagaaggaggaacagggtgttagaaataggaaggaagataaagtgagcttctagtaccaaaatgtgtcatataattacagtaacattttccttctcttgctgtcattctcgctactggggaggcattaaggattgaggtactttaccatgcagacctgtgttttatctaccatagatgaacatcactgtaaatggtcagccatgtatggctataatttgtttttatagaaaatgaaaagaatagtgttgggtgatttattgggaagaaattaattagagaagctttgcctgattaaaagttcattagaaacattatggtttataacgtagtattaaattcagggacataataagaaagaagttgaggctaggccaaaaaggccagttagggtaaaccaatatggaagcacaccagtgtggaacagggcattcaaattgtcatgaattcgttgaggagcttctggaaagtgcacattctgactcagcaggtattggagtctgcatttctcatgagcactcaggtgatgtttgtgctggtccttggacacagctctgaatagcaagggaatagctttcctttagagaaatctggaaaaagaaccactggagagcaatttaaaaaataacagaatccagggaaagctttaatttccttttatttctgagcatgattctagccacaggggaaggaaaatgagatgaaaaaagagagattacaggtgtatactactgctgaatacagatgaaaaaagtggtcacaatcatccataaaaagcagttaggaagggaagcatcaggatgacagttctgataatcattttttcaaaggaagagggatggtgaaaggacacaaaaggaggaaagaaggacatttgctggggtcttgggagttaaagccaagtaaacttgagacaactcacttccagttgcttcagcatatgcccagtctcacaaaagaggttattgctgtggagagtactggagacaggagggagtgctagagttggggtaaaccacagcagctcatttcacttgataactgtcaggcctcagggagagaagtttcactgacatgagtgaataagatatgattaacttgcatatagatgctttggtgaaatttttttgagacagccagttctttgatatgatagctgttttataaaagtcctttacagtgtaagataatataccaaacttagttaattttagaagtaatcataaaattcattccatgaaaaccaaaattatcattttcaataaatactgcactgattttgaaatataaatatgtattaatatccagcaagtctgtggtcattcaatgttttcttttttgataaatattttgatatcagaagcttattcgacatggtttatttgatgtgttttatggaccaccttgcatgagtggatcaaggagctctaattcaaggccaaatgaggggataggagaaatgtaggtgctgcagtagcccatgtgatcatgggaaaaatgagtagtttgattagctgttatttcataagtgtgtatcctagctgatcaatgtagaaccctttctttgatgagaggtgaatcccacattcatctgaactgtcatcccaactgcgtatttcctcagtgacaagacaaggggaatttatttgtgctgtgctggcagcaatgcctctggtgtgtggagttaaaatactctgtacattcaccatcagctttgacattgattctctcaggtttaatttgcccctctgtttaatggtcccttttctccttatcagtccacgtgttcacggttatatcaatgcttttctattttaagtataggcatttgaaacataatctcactaccgaaatgtaaactgtgcattttgggaatcctatattcctattttcctcattgtgtttctgtcatgttgctgtcctaggcaatgaaaagaagaagccaagaagaaccctcaaaaccttaagtaattatttttatagccaggcctgagaattcagctcgacagtaacactgcatgaatgtttggttggccctgtcatacttacatataattgatgacatatcccctttgctttgtagggcctcctgcaaaacatccttccttgaaggtaattaattatgtatatttttgaatcactaactccatgttgtataaaatatatatgatttatgaatcgttttcttttaaaacccattcagcctagcactgaagtggaagatcctgctgtgaaaggagcagtacaaagaaagaatgtacagacattgagagcaggtacatttaatggaatactgtaaataaagtacattcaatgattggatgtactcatattattcttattcctaattctatttgttcaatattgaacagaaggctttgacataaatgttattgttggtatccatatttgaataaaaacaaatttagaagcataaaaaagattttaaaaatgtaagctttaggtcagatgtttctgttttaatgttttgaatagcatgaagttttcagtataaaatttttatacttgtcagggattcaaagcagtgaattttgagactcttaagatatttccagtgagttaagtgctagttggagttctgatctttacctagaggaaagctttacttattaaagtgtcagtttctgttttaacttcagaggcttgctgctagtgttattacactgatgatctgaagcctatcagatgttctaatgagtaagactgtgtgtgtaggtgtatatatagatgtgtgtatgcgtgcgcttgtggcatctttgactactacaaatgatgaaagtaatgattcatttatgactggtagacacagccttttaaaatggtgattttgagcctttttggtgttaaagtttttaaaacatgattgcatagaggctaccaacatcataagttggttgtttttcatttcaatgcccttttgaaatctttaactacattgtgatgctcagaaataatatgcagaattttttgtgtcctaaaatggtatgtgagtggttatacagtttatatacctttctgccactttctttggtgtgttttgtattatactttccacttgtacccacattggtgtgattatctctggtttaattcattttacactgttcattgtattccctcataccactttaccacatttagttagactctcctgttgctgataaatgaagaaataaaaagaaaaataatgtcagattaagagggcttttctttaatcggtttgtatctattagcatttactatatgagagtttaaacctgaaaagttcagaatacaagcatgcaccaccatattttattaatgcccttagaactatgactcatgagcctttagcctatgaagttaggacaattcatttctctgaagaagaatgctgggctgttctcagaaaagaaaactgaaaatagcaaatgatattgtcttattttacctcttggacatccttgaatgaaactgctactaaagggatactcggatcaaaattcagatctaatgttttgaacagtatagtttgtgaatgtccagtgatcatgagcccttgatggggaaatgacctttcgagtttcacttttgcattttttgctcttttcgttgacttgtcttgaaagcttaaattcaactattttatttttacagaaaccaggaatataacttttaaaatatatgtctgtcctgtctcacggtgttgtgtactcttcagatcttgtatgaacatagacttatatgggaacaattaggttttttgtttgtttgtttgtgtttttgaggcagagtcttgctctgtcaccaaggctggagtgcagtggctcagtcttggttcattaccacctctgcctctcgggttcaagcaattctcctgcctcagcccctcgagtagctgatactacatgcacgtgctaccataccctgctaatttttctatttttagtagagatggggtttcaccagtttggccaggctgctcttgaactcctgacctcaggtgatctgcccacctcggcttgccaatgtgctgggattacaggtgggagccactgtgccagctacaaataagatttttaaggctattatattttatacaattctttggtctatgtgaattctgaaggtattcatgcattgagggaagattatctcagtttaatgaaagcagtttttaatttaacgtatattcattaaattttttttgaagtttttgtctctagtacacagaaacacacaataatgtcatgggtatttgaccttaatgtgtttatgcacaaacttagttattcaaatattttcttatccctgaagaatcttaattactaataaacaaatttctcatggaaaacaacatatataacagagatggttgagtgattgaaagtaaactgtagtaaatgccagaagcttagaacaagttaagtaaacttgtctgagttaatagcaattacaagacttttaaaatacattagaccacgggggagtagtgcatttgtggggtagaggacaacatggtactgcttcagtgaagaaagaacttttacaccttattacaatttgtattattatttacattctaataaataaaaactttattttcagatattttacatcatgtttctactagttgaaccatcaatagtaagacttttcaaagatttgggaagttgtgagttgatgataaatatctgtatcaccatcagtgatcaaaaatcagacagcaactaccacagattttggacacgcgaacttcatagttaaagaaaggattaatcttggagctgtgtttctatcaaggaattacactcttcattacctgtgtgaatcgcagttattagagtagaaagagagcaaagaaggaaaagaagcatagaaaattttattgtagattacctcgtttggcttcatgctaccgtagttctgacttttaaagagtcattttgtggtcaaatgtactttgtgttcactccccttatgcagcctacaaccaaacagaatggttcttagcaaggcatttgtattcttcccttaaggaaagcaacatataaataacaaaaagaatgagaagaaagagtgattttattgaggttggtatttaacataaatttgagtgcaggtaccatgattatatttagaattttttggctggatgggaaaaccagctagatgtctatagatttcctactcaaacacaatgtgcctttgttttacttttacgtctctaatttagcaattattaggtacaactgtatgcagtgtcactaaaaatacctcccaaaaccaaatattaaataatgtctatggctttctgttttatagtgttgattttcccaatattaatgggaaccactgagcatttgccttgtggtgtctcctccgctgtattcacatattccatcaccttttcttaatggataatcatgcgctatgagtaagggttttcagaaaagctgtgtcatttaaagataacacaggagcatcaaatttaattctgctaggacgcctggtctactgattaactgcagctaatatgaggtctacttcacatccaagttaaattcagtgcccttaatcagtcatatgatgaggtcaacagtaataaattatgcaatattttttcacccacccctatagttttaatttctttttccccttgtgtctgtgtttaacattttgctttgcaaaacatgatgataatcttctagagtagtgaggacaagctataaatccaaagtttctaacctatgcaaatgacttgtttgctctattttctcatgagcttggtagatccaggaaacagaacttttaaaacaaaatcaccatatgttgctgggtgcggtggctagtgcctgtaatcccagcactttgggaggctgaggcgggcagataacctgaggttgggagtttgagaccagcctgaccaacatggagaaacccatctctactaaaaacacaaaattagctgttcatggtggcacatgcctgtaattccagctacttgggaggctgaggcaggagaatcgcttgaacccaggaggcagaggttgccatgagctgagatcacaccattgcacttcagactgggcaggaagagtgaaattccatctcaaaaaacaaaaacaaccacaaccacaaccacaacaaccaccacaaaacccaaatgcatttccttggcacagtaaaactgaaacagaaaaagggtaaagtaaatacaagtaactgaaagagtttatgtatattattttacttctcatttgattgataaaatttgtaaagtaatgagcagagtgtatttctccagggacccagatatatacatttatttattcaatagaaattcattcttataatggccactgatacctatatcctaaatatttctgaaaacatctcctcaggcctgcatcatctttgcaacattgccttatattttatctttgttcattgatttatatgcctcagaattttatgctcctcacagtatttagagtgaattatccctaatgcaaatagatccgtgaaccggtcctgaatacctaatgtccaagcatcttaaaggtttatataaggatttcagaaactgacttctgggtagggcacggtggctcatgtctgtgatcccagcactttgggaggctgaggcaagtggatcatttgaggtcaggagttcaagaccagcctggccaacaaggtgaaaccccatctctaataaaatacaaaaattagcaggtggtagtggcacgcacctgtaatctcagctactcaggaggctgaggcaggagaattacttgaacctgggaggccgggttgcagtaagctgagatcatgccactgccctccagtctgggagacagagtataaccttgttccaaaaaagaaaagaaaaggaaactgatttctgcccaaatctccatctgtatccctttccccatctgcctttttctctggaattaccgagctgctggtaatggccccctcaccattcctcttctgcagagaaatacatactctcttggaggcttcttgtcttctcttgttgctgcctggcatgtgctcaccctttcctgccctctgcctcgcttaatctggctaacctcactctctaagtctcagctcatggatgatctttaggaaagccatccccgacagcttctattttccttccttattccccagtgcctaacacttagcaggaactcaataagtaattatttagcaaaattaagactgtttatacaaagatgattcaaaagattgtcctctacagtctagcagcaaaggggtcaacatgtaaagacatgatgtgcatgtcaggtggtaaagtgacactagaaaaattgacaaggtactaagggaccccaacgaagcagacacctgtgtgtgtggagaaagatagctagaatcaaggaagatttcacaaagcattctgagccttttttttttttcctctttttggagacaagttcttactctatcacccaggattggagtgcaatgacatgattgagactcactgaaacctcagactcctgggctcgagggatcttctcatctaagcttcttgagtagcggggacaacaggaacatatcaccatacctgtctaattttttgtagagtcaaggttacctatggttcccaggctggtcttaaactcttggccttgagcaattctcccattttggtcttccaaagtgctgggattacagatgtgagctattatgcccagcctactttctgagtcttaaaagatgaaaataaatttttcagaatagcaggggaaaacatttgtgatgtaaaaaatggggtgcacactaattgaggtataaagaacaataattttgcaaattattagtaactgccaactcaattagtgtcttgttaaaaagatactgttatgaagtatagtaaagcattacattgtatattttgactgtatttcaaatttctgttttgtttctaacagttttgttgacttatgttgggtggaacaatttgtgagtgaccctgagattttgcatggcttgaatctggtgatatctggtgtctccccaagtggtttgttgaagttttggataattagaagtatttcttacagaagtaaatatttcagtaaacattgtttcattcaaactctcaaaatataaaatacaaagaaatgttattctctatttatttttataaagattatagtctttaactcttcttagttcatttgaactaaatcaatgaatttgtcaacagaacaaaccttaccagtggctttagaggaagagcaagaaaggtgcaaaagaagtgaaaagaagcaatcacaggtatatgaaaatttaagttcttgtttaatattaggttttttttttttgctttactaacaaagcatagtccaaatgacatgacctttcagactatacctttagaatccaatagatcataattttatatgtaatttttaaaacatcttaatcagttatgaaacttaagatattcttactatctctagtaactattagttattctagtaattcttagtatctctagtaactcatagctgtctttacccttggaattgaggcaagaaattttcagaattatcttgctgttttatttatataaccttactcataatacacaaggtaacatgaagtattgggtcatattactgaggaatagaaattatgaacagtttaacaacaatggccactgagttaaactagtgttaaaggagtcatcattgccagtgcttcaaatgttgcagttttatatttctggacaccagtgccgaggttaaagatttattctgttttgtggtcaccagttgacttctgtgtctgtgttcagggagtgaatggggtcataaaagtcaatgcagttgcctattaagagaatcctaccttgcagaatgggatctttggtgtcagggtgtgaacaataactttatttcaacataaatacatagtaaacattactaaaatttaaaaaatccaaaccctatcactaccggaacttaaaatatattagaagtggatataagcagaaattctatctagatacataacactatcatagtatatcatttgaattagaatttaaaattttgcttctctttcttattggtgttcagtttagctcttaataatttagtgtttgcctagtgctctagttaatcttcagaaataaacatgcactgtaggggctcactctttctggtatgctgaggtaaagtctttgtaagagaggaagcttttataatactacctatcatctttgaattcatttctggtagattttacacaaatgcattaagtttagtccaaacagacactgagagttcagcttgctggttcatgtttctgtcctatgttaagccaaggcaaattatttttcactttttagttacaatcctataatttaagagtagcaacacatagattaagtttcacagttaaattttaattattttctaatatttctttgtttatacttgattaaagctaattttaaaacatgcactctgacagaaaagacatctgagaaacaaaacaagcaaatttgttttccattttgcacctgccctccaccaaaaaaagtctcaagaatcagaactgggtaagaacagtgataaggggaatcaatctatatattcatgactttctttaaaattcattacaaacaagttcaagctgaatattggtaaaagttctgaaaactccaaaattactgcttgccctgaggaagagctcctacatggtaactctaaagagggatgaacaaaaaaggagtgccctctagtctgatgaatcatgtccctgattttgaggagaaaaatgtatctggagggtctagctctgtggcagtccaggcagcgcctgaacagaggaagcccatgtcaaatgtctttttattccattcacactccaggtccctgaaatacacttaccagtcatcttctaagcttcatttaaattaaaataaatcagactataaaaatgataacaaaccagacacacagcttgtttctaacacagatgatgaaaatttttgttatgatatagaaactgaaaaagtaaggaacccagtaattatgattgaaatgaaagatgattaagagtttgacatgcaaatggaaaaatatataaacccaaataccactaattggaaattagacattaggcattggtctcagtctagagatccagaaagtctttttgatttgtggtttaccttccccaaagaaatgaagcatatgattcagatagaaagccacagtatttctgctgctacagatacttataaaaacagaaagccaacacaatgcttattccagaagccactgaatgacaatcccagtgttaataactacaaaaccatgaatcttgaattataaaatccgggttattctttgccacatagtgagagaacatcaaaaatagagctagaaacttacagcaagatatttcaaggtcactaacatagcacatgtatacatatgtaacaaacctgcacattgtgcacatgtaccagaatttaaagtataataatagtaaaaagaatgaggtaggcatgttacaagtagagttcctggctttggagaaagagaaagtccaacttcaaaaagacagaggttcacttgctgcttcttttttctctttatcaattatttgatttagtcaaattttctattcaagaaaatcccatgtgtacagttacagcggggttttctaaatgtgtaattatgtgtcaaagtagactagtcctgctatctaaacaacggttctggagaatgttctcataatgtttgttcattaatcaacctaattctcactctcagtcttccaagtggcatatgagctgggaaactaattcagccatataccatgtgaccttctgaaccagatcaacataaagaaattgctaaagaaataagttttagattctagattctttttactatagtcatttagagatgaattacatttatttaatgatagaatgggaatacaacgggagggaagcaatgactgagatgagccacaaaaacacttctagccttgagagttgcaatgaatattcccagccaaatgagtctgtttaatgtgttttcatgcatgcaagtttatctgcttagctcaaactgtttgaatttatagttccatcatggttatttctaatattttgaaaacaaatatatacttccacatattttaaaaaatcaccactccaatatttctgttgaatcagaccttacattatgttgtttaataaagtatggtaagttttggcatgtatgatttttatcatgtaagaagcataatttcttagctaaaaatttaacctttgactctttagtagaaagttgagttctgtacactgtgttctaaagatagacaaaaatctagagattttcttctttcaaagtaaaagtagatgaggcctttttccaccctctgaggtgttaaattgctttgctcaagttagacttttaatatatctgactaatttgataaatttatctggtaatttatgtaattcagtaacatggaaatgtatcatgttatttggtgccatgaaatgctagggaatgccgcctcaagagctctggatgaaacatttcatatgtcttggttggtttgactcccgttttcagtagataatatggcttaagtagataactgtaccatatgtgttccacctataaacatttgtggtaattgaatgtgaaatctgggaagcatctcgttttccagaattctgcactagaaactcagcagtttcactctgcttcttgtgttgtggcaaacaaacattggttcccatagttcagggagaactttcacttttttgatatcccaggattcaaaaaaaaaataaaaagagataaaaggcagtggggaaaagaatagctcagtgcagaaaagggaaaacttctttactgttcttgaaggcctacaaggttacttcctcttaatctggctatttcatgtaaaatccatgtggcaatgacagaagatatatgttatgcctgtgtctttttatttctctgtttctgccagtcaactagcataaacatttatatcagatagcaaagagtggatgcgaataaaagcacaaaatggagaagagtcctttttgaaattttggaaaattcttccattcactcaaacagaaatgagcagacttgacaaaaatttcaatgataaaatgatgagtatcttataattattatgtataatgataaaattaaagtaagcacaaaatatttttatcattaaaatggcgatagttaacctgaatcaagttaaaaaatcagggaaaaagttttttttattgaataaaataataattattgttcatattacttttattaaaggtcaaagaaggaaataatacaaacaaaagtgaaaaaatacaactatcagaaaatgtatgtcatagtacatcttctgctgctgctgacagattaaccaaagaaagaaagattgggaaaacgtatcctcagcaatttcccaagaaactgaaggaagagcatgataggtaagtaagcctatagcagtttttttttttttttttgagatggagtttctctcttgttacccaagctggagtgcaatggtgtgttctcacctcactgcaacctatgcatactgggttcaagtgattctcttgactcagcctccctagtagctgagattacagacatgtgccaccatgcctagctaatttcttgtatttttagtagaaatgatgtttcaccatgttatccaggcttgtctcgaactcttgacctcaggtgttctgcccacctcggcctcccaaagtgctgggtttacaggaatgagccaccgtgcctggccacctatagcagtatttctcagcagataattgtcattgtgctataaactaattcaaaatcggactaatgttcattatgattaaaaagttttatagttttaccagggatatttagccctgcctggtaatcagaaaaatgcaaattaacataaaataagatatattttgtaaagtcatgctgatattgaaaaagtaattcctaccattgaaaatgagaggaaaaaggcattctcatacactgttggtatatgaaattggtaaattatttctgaagggtaacttagtgctgtttatcaaaatttcaaataacctgacatccccttaactcaacaactccacttctgggactagatttcacaggaaaacataacttgtgtaaacatacacacacttattaagggcattaattatatattacacataatgaacaatagcttaataaatatataaaatatatgtaataagaaggtgaattggaagtattaagaaagaattagaaaaagtgtggggtaacagatgttagactctttagcctagttttagatgacaataatctgcagatatagtttgtgtgagagacatcttactctgtaaatcatttggagagacacctgcaatatttcatagagatgaaaacttatttctagtgaacttatacgcttgtcaataaatagtaactttaaaaatttagttgattgtaaatgaccttttctaatcaggtagtaattatgactgtgtgatttgaaaaggtagttttgaacttctaactatactgaattatttccagtatctttttgtataatacatactagagtgactagtaataaaaactttagcagaatattctttccttactacttttcaagtatatgcattcgtttgaagatgttgaagtgagaaattaaatatttgagaactacaaaggaaaaataatccagaacagaaattttactaggatgataaagagcatctgcagaggtagatcacaggatgatctctttattttttaacaaaatgaattttaagataaatgtctttgtctgcagatgcatcttaagacaagaaagtgaagaaaaaacaaatgttaatatgctgtacaaaaaaatagagaagaattagaaaggaaagagaaacaatataagaaagaagttgaagcaaaacaacttgaaccaactattgaatcactagagatgaaaccgaagactacaagaaatactccaaatcagataaatcaatctttggtaaaaattctatattttaaactttattttatcaatgttacttataatatcctcttgatttaatatataatattttggtctaaaacaaaccagaaatgttatctcatttttaaaaaatgaatgatgacacttacaggtacaattatttttattataaatcttggcatccacataggatattattttattacaaagagcttttgaaaacaataatatgccataatatatacttagtgataacctattgataaagattttgttcccagtaaaattgttccttgtacttcccgccatttcatattgattactgtacctaatactataaagaggaaacaaattattgcaatcacaaataatctcatgatattctaagaagagctctataaattttatcttatttaccattggtgttttgaaataaaagttttctttcgtattgatacatttacaccacagaagtaactgtgatctgtcagagaactagaagtagagtaagaagtcctggggaaaatcctgtagcttgcttatatttttaacatttctttttcaaatttgtggtaactagatgagctcatcaatgaatgtatataggagtgactagtataatgtctagatttacgatttagtaaatgtaattctttcaactgactataaaagtgttaaaagagtcaaattaaaatagaatgttatcagtgaaacagaactgtaataactctgggaaattttatctgtccaaatatgtgtgaaataaggttcttactatagggtggtgtatgggttagatatcaaagtgtaaatgcaatttttgatatattttaatttagtcaaatttgttaatgctttaatttatgcttttgagtttgttgtaattcagggaaaggcttttccaattctgaaattcttaaaaattctctggtgtgcgtgtgtgtgtgtgtgtttacttttataaattcattgactttaaataaatttctgaactttttggaacttatgctctataaagtacaaagttttgcttcaactttttctccagttggatatccacttacagtaacctttttagtatgtggatgtgcaggttattctttaacttcagaggtaatcatgatattttattgagtactagctaaaactttcttttgttttatttaggattttcataatcaggaagaaatgaaagatctgatggatgaaaattgcattttgaagacagatattgctatactccgacaggaaatatgcacaatgaaaaatgaccacctggaaaaagaaaataaatatcttaaggacgctaaaattgttaaaaaaacaaatgctgcccttgaaaagtatataaaactcaatgaggaattgataacaaaaacagcattccggtatcaacaagagcttaatgatctcaaagctgagtatacaaggctcaattccgaactgttgaaggaagaagaaagcaacaaaagactggaagctgaaattgaattatcagtctagactgactgctgctataagtaagcacagtgaaagtgtgaaaacagaaagaaacctaaaacttgcattagagtgaacacaagatgtttccttacaagtaaaaatgagttctgatatttccgaagtagaagataagaatgagtttcttactgaacaactttctaaaaagcaaattaaattcaataccttaaaagataagttccgtaagtaaagagatactctcagaaaaaagtcattggctttagaaactctccaaacgacctaagccaaacacagcagcaaataaaggaaatgaaagagatgtatgaaaatgcagaagctaaagtgaataattccactggaaagtggagctgtgtagaagagaggatatgtcaactccaacatgaaaatccgtgcattgaacagcaactagatgatgttcatcagaaagaggatcataaagagatagtaactaatatccaaagaggctttattgagagtggaaagaaagaccacatgctagaagagaaaaataagaagctaatgaatgaatgtgatcatttaaaagaaagtctctttcaatatgagagagagaaagcagaaagagtagtaagtatcaaggaagataaatgttttcaaacttttagaaagaaaatttaaacatttggttctggatacatgttgaacttagttgaatataaaaatcaatggataaaaagtgtgtttaccatactgtataattccatttacatgaagcatccagaaaagataaacgtatagggacaaaaagtagactaatgtttgcaaagggctggggctgaaagctggtagtgactgctaatgggcgtgagggatcttgcagtgatggaaatgctgtaaagttggattgtagagatggctgcacaactcagtaaatggactaaaaaatcttttaactttaagttaaaacagatacattctatagtatgtaaattatatttcaacaaagctgttttaataaaaaaaaaggaaaaccgtgtttactataccagcttagaaacgtgccccatttctaggaaataaaaggtagaggtgagagatgatttactttgagaaaagacattgtgtcacctatgaaattttattaggcacagagtcatattttaagatagatagttctgtactggtgaaataataattttaatgactttatgttgccacatgttaagaccataatgtaagtataaatggaaatgtttacacctgaaatgagtattttcaaattaaaatttaattgattttctttgacacttaattctagatttcccagatgaactgaagtgtattgctgtgtcttgtaataccttgctttaagtagctttttatgtattttagttggtatatctttgttattaatcatattaatttaacaaatctgaaaatatgtcaaattacatatttttatgactatgtaatgttttaaaggcacctacttgttataaaatcataatttaggatacatgtggtaatatttagcaaaagtatatttggtttagtcttcccactggtatttatagtttactttgaatatttatattaataattagctcctaatttttatttcaaggctcaatggctatcattggaatataattttgttcagtacaaagatacttgtagctgcctgtgatttatgaataaggcattagatccctattttcagactgaggggtggcaggcttcacgtacagtgggaatggagtaattacaggagggagttgtaggagctttgaagtcagagagggaggtagagacctgtttacctaggacctcaaaggccattggaattttacttttattctgagataggaatctgttggaaggatttgaacaggtgattgaatatgtgaggaactttgaggttgagttgagcttctaagatgattgaatggtgggatgaatctgttatgtaagtaagagaataccaatttggcaggaagagaacatattgtgcatccctcactgaattcagtaataaataaaaatgtgtacatgtgattaaaagaaggtgaatcgatatgtgtggtgataattttcaaagtacgtatgttagagttaaatattattaacataatttaataataaggcaatttataaaatcagtaacaaaactattttctcaggtggttgtgagacaacttcagcaagaagcagctgacagcctaaaaaaattaactatgttagagtctccactggaagtatatcacattatcacattaatttggatgagacacaggtcccaaagaagaaattatttcaagtggaaagtcaagtatgtatggaacttagcatgtcaacggttattctgtagcttgttgaattacataacatgttttaggatactaattatggcagaagcttgattttttattttcattacaatgaattatttccattttactatctctataatgtacttatttttttatatagtgactttcattctaccattttgaaaaaccattgcataccttttctcttacaatatgtacccttgaaaaagttgagaattatacatcattcctcatagaaaactgacttttgtcctgttaaaacagtatttttaagtaatttttgtattgctctgatgaggcaggccagattaaatcagagaagaatgtttcatggaatgttccagaaaattgtcttatttcttcacttttgtgagtggacacagaatctgtgtctatttatttcacagattctaggttaacttgtacagaaaggccattatactattcttttaaaagtgcatgttttaggttaatttacaaactatttgaaaagttaggcattttctttatcttttatttaaaatatactataaaactgtggaaatatttaaatttgagataacatgtacatcaaaaattgagagttgagaaaattatcttgatcctgcctttggattttaaagacagtttcactgagatatcattcacatttgagagagttcaaccatttaaaatgtacaactgagtatctattagtatattcacagcattttcatcacctgaaaagcaaccccacatctcctaggcatgactgcagccttcctccatgtccctccacctacctctgttgtaggcaaccaccatctatctacttttgtctccatatgtttacctgttctgcttatttcatatacatagaattatacaatacgtagtcctttgtgactggctttttcacttagcataatgttttcagaattcacttagcataatgttttagcacacattggtagtttatttcttcttatagttaagtgatattctattccatgtctatactggttttccattcattcatcggttgatggacctttaggttagtttccactgtttagctcttatgaaaaatgctgctgcgaacattcacttacaggttattatgtggacaagcgtttttatttctctgccattggactttatcctcagagttaattgggcagatttcagcacttgtcttgctcatgctatcctttctgccttctcagtttctattcatctagcctcattcactcagacgtggcagacaatttattgttttcatgaagctttctctgagtgttctctcattgacctcatgtgttagcaatcgttgtctagtctgtgcagaaaaacttagttcttaattttacatggcttttatttttttatggaagatagttttctctcattataaatttgcttaatgggggaataatatataatatgtatgccacctatccttgcatacattgaaaatattttagcttagaagtttgtagcatacaattcaatactttataccataccaattatttcttctttgagaccttgacacagtaaggtttgtattctaagtgtgtttttagcaattaaatatcaaagccaacccaattagtctaatacaggagactcgttcaatcacatgtttatgtttttctctctatgaaaaataatgtaaattggccttttttcactatgcagcagaactgtgtttctggactgctaccagtttgtcagctgaacagttctgggtgcagcttgtccgatgacggatagcacagcccctcaatctgtgtgctcagcagagtgcttgtgaaggcagcaccacagcaacagttgctcagagggaacggattcaggagccttgatttagcaatagagtccagggttttcagctcagtgtctttagcctgtctctgctggtcatgtcagttatgtactattcaatccaggaggtgctgtttacattgtagtacatacatagtcattgcctaatgagtcatacagagagaaaagtaagttataaattatgtcccccatttgctgcaactctcagtggtaagaatgattcagtgcagctataggagagtacttccattggcatgccacctgcctaaaatacacaattttgttaagatatacaataaaattattatgctaatagcaaatattttatgtagctcactatgttccacgtagtcttctaagtgtttcatgttagtccccagttaaacacctggttttggaaggctgaagcaggaggatcgtttgagcccatgagtttgagaccagccagagcaatatagtgagaccctgtctctaaaaaaaaaaaaaaaaaaaaaaaaaaaaaaaaaaaaaaatttaaacacttatctgaggcatggtggtgcacgcctgtagtcccagctacattgggaggctgtggtaggagggtcgtttgagcttggaatattgaggctgtagtgaacagtgatcaagccgctgcactccaggctgggtaacagagggagactctgtctcataaataaaacgttttgtatagattcccttagaagtgagttagacatcagtcatagaattattagccactttgatgtctaccttgggagtaaaacatataataaggggcagcattaaaccatctcaatcactagcctccaacttctcaagaaggttcttatttcatgaatttctacacaaaagactaactgggttaagacatttggtggacaccattttgagatgaagaatcttgagtgagaagaagggagatctctacttactgaagcttcccaatgacatagttaaatgtcccccaaaagaaactttagaacaagactttcatcatgccatatctctatggaaaaggaatttctttaaaagaaaacaaaggcaaacaattgataatatgattctcatgggaaagttttcatcataaaagaaaaagagggctgggtgccgtggctcacgtctgtaatcccaacactttgggaggctgaggtgcgtggattacctgaggtcagcagttcaaaaacagcctggacaacatagtgaaaacctgtctctactgaaaatacaaaaattagccaggtgtggtggtgtgcacctgtagtcgcagctacttgggatgccgaggcaggagaatcacttgaacccaggaggtggaagttgcagtaagccgagatggtgccactgcactccagcctggatgacacagtgtgactccatcaaaaaaagaaaaaaagaaaaacaaaaaaagggacaaagtatactggtccaaaaaagaagaaagcaagaaaaaaaggacaaagtatactggttagtatcataacagtgagatagtccccctttgagattagaaaataacagtatactcaaagtaacattaatgagaaccaacataaaatagacaacattcactatctacaaaagtaatctgcaccaattagcaatgtatgagcatgtggttgagaatattttctataatatgggtactagaaggaagagacctcaagaaaatggtcagagctggaaatgtagattagggaatctaggtcaaagttttgagattttaggagtcctgagagaatttaaaaagagaaatagccaccaggcatggtggccacacctgtaatcccagcactttgggaggccaaggcaggaagatcatgaggtcaggagttcaagaccagtctggccaacaagtttcttatataggtaaacgtgttccatgatggtttgctgcacctatcaatccatcacctagatattaagccctgtgggcattagttattgatcttgatgctctccctcctgaccccaacaggccccagtgtttgttgttcccctccctgagtccatgtgttcttatcgttcagctcccacttataagtgagaagatgcagtgtttggttttttcttcctgcattagtttgctgaagatatcagcttcgggttcatccatatccctgcaaagagcacgatctcattcatttttatggctccatagtattccatggtgtatatataccacattttctttatcccattatcactgataatgtccatctgggttgattccatgtctttactattgtgaatagtgctgcagtgaacatgcaaatgcatgtatctttataatagaataatttatattccaacgtatggtaattttaaatcagttttggtattaaaaatcatgcattttggaaaatattgataatggaaaaatccaaattctgccaaaatatgttgagaaaatagagagtaaatatatcttttcaaactttaaatgcctcaggcttttagttaatcttccccagatctgggaagacctagaaggggagattgggctaccttaatgagggccatttcaatctcttggccctgcagcagccatttcaaaatacgtcaaacaatatatttgggggtaaattattttgatttccttcagcttcttctctctgtgatgttgcaccagaatcagattagaaaggaagccacattataagtgttaataaaacccatctgatgagatttgatagtttgaagggtgtgtttcccagaccctttagatagaaattagggccaaggaaaacaaggtcttattcctctatataaatctgtcagtgctttaagcagtgaaagaaagatttttcattgaattttacagacttgatactaatgaaaaggatagcttgtaaaatataaatctatttttctataaaaaggacatgttgttgattctcttagaccttgaaccctggccagtgatttgaaaccaagcagtacctatctgcagatctctagtaccaaattaatttggggtggggggtaacaggtttattgagaaataatgaacacgccatgcaattcactcatttaaagtatagaattcattaactttagtattttcagagagttatgccgtcatcattacaattaattttagaacattttcatcaccctaaaaacaaaccccacatcatttagccatcttcactagttttcccttcctccctcagccctagggaaccacccaccttctttgtatagatttgcctataagcctctgaaataaaaagcaagtggtctgctgggactggcttatttcacttagcataatttttcatgctgcatctgtgctgtagcaggtattgatgccgggtttttgctccttagttcagctacatctgtgttcttctctcatgaccaggaaaaattaagcctgcagacacattgaggagggcagaatttattatgtgaaagcacagctctcagcaaagagaggggtcctgcaaagaggtttccacctcacaattgaataccaggagcacatgagctgaagcggccaggctcctcctctgcataaggtgtgaattcctggtgactccaccccatccccccactgcatgtgggcctccagtctgctgtgggcatgtccaggcaagacaagtccaggttcccttatctgcacataacatcaggtgtaaacacttgtggggctcgttggagattctccggggacccttccgtatctgcctaggcattttgctgtctcctcctaatacggtatctgtacttaatttcttcttattgctgagtaatattccattgtatggatacatcaaacattttatttatccattcgccaggtgatggacctttgggttctctcccagccaaaggtgacagacgttctggttctttccaccttttgactactattaataatgctgttgtaaacatttatgtatgagtttttgtgcttgcgtatgtttttatttttctggagtatatacttatgactggaatttgtgtgtcatatggtaacttcatgcttaaccctttaaagagctgccagtttgttttccaaagtggctgcatcactttacattcccagcagcattagataagggttttaatttctttacatttttcctgacactcttttttcttgaacaaagattttatcctgtggtgtgaagtgataccacatgtggttttgatttacattttcctaatgactaattacattaagcatctattaatgtgcttttccatctttatatcttctttgcagatatatctattcaaaatctttgcccattttttaaaattggcttatcttgttatttattaattgcaagagttatttatatttcctatatatgtaagtcccttatcagatacacacttttcaaatactttcttctacttggcgtcttaccttttcatttcttcatgctgtcttctgaggcacagcagttttcaattttgaagtccattgaatccatttttcctttggagtcatagctaagaaaacactggcaaatgcagtcacaaagatttatgccagtgttttcttctgagggttttatagttttagcttttacagttaactattttattttgagttaattattaaataagatatttggtcgaaatttatttattttttgcttatggatacccagttgtcccagcaccatttgttgaaaagactattcttttcccattttgttcttttgtgaagcttgtataaaatcaattgactgtaaaagtgcaggcttatttttagattgtcaattcttagcttgtttatgtctattcttatgtcaaggcccaatcgaattgaatgagaagtttttttcaatcatgttgcatattaccagttgtcttatgtcataataaaaattaaatttagtggaatgtctgtaacttcaccttttgtgtcacaaaggagtctctggccagcttataccttacttcctctaagacatgatcagacgccaggcttacaagacacacttaatttctttttttctccattcaagcctttagtctcttttccattgcctcccactatagttatattttcagtaagttttggttacaggatctgctgacatagtctaatattcagtgcattatgttttactaactcattataattcatagaaccttccatagatgtctaccatctaggaaggagaagtttaagtctgagccgccagctttcctcagtggaaatcaagtgaagtcatcatcttgcagtttacagaccctcttttctcctggtagctggttctcttgggtagcactgtggctaatccttttattagtgcagatcttgcattctcagaaaccacagttccctatattgacctccttttactgaaacagagatgcacagctctgctttctagctcagtagaggattcttggaataaaacgtttaactcattccaagaaaaagtcttaggagtgcagcacttcaaagtcaggtaaggttcaggcaatttatcagagacacatagtagattagtattttgactttcaaaatttcagagccaagttgtgtgctatagagaagcattgtggcataacatagagatgggatggtcttaacttctccatacaaacaagcttggagtaaggtaaaggagaaattgcatttgtgtcttaacactcaaaacacactatgcttattttacttctgtgaagaataaaaatcattccataatattctccttatttcctcatttagaaaagaaaatgaaaattgaatactaggttgattaataaatactcaaaacttcttcttttagaattttagttaattgaaatcaggtaaatgtctgattttgcctatgtcacccagtatttctagttgtttttcaaatcatacatcttcttgcttcccagtcttacttcctaacttgaggggaaattgtaagaagacacccttgccttgttatcagcgttcattattgaagttgttttaggaaaattcctcctcagcagcttatgtctctctcctggttatctactgcttctcaataatgtttgacatcaataaataaatatcaacctttattagatcctgctttaaaggagactcttttctgctgcataagttatgtttcctgttgtctctttttaaaacttattttcctaacaattacccagagtcttgtggcttgaaagaaaaacatttattttattcatgaacctgtggtttgggaaaaacttggccaggacagcttgctctgctcccttcagcttccctaggaacagctgatcagttgcggaaatggaatcctctgaagctttggtcccccacttgtttgatggttgatgctggccatcggctgtaaacttggttgggacaggcagcatgaacactgacacaggcactttcaggctctctttgtggcctgatggctctcacaataggggctgggttccaagggaaaacagtctgagatagggaagccacatggtatccctttcactacattctactcattagaaggaagtcagtaaggctggcccatattctgttttttaaatgggatgaatgtagcttctcttttgttttaattgacacatatatacataattatgggctatagagtgatatttttatacacgtatatagtgtgtaatgatcaagctaactagcacatttactacttcaaccatttttcatttctttgaattgtgaacattcaaaattttctggctttttaaaaatatacaataagtcatagttaaccatattcaccctacaatgccacagaacaccagaactcactcctcttatctaactgtaattctgtatccattaaccagcctcccctcccctacttctgtgagctttttttttgttaagagacagggtcttgctagtgtagtctgggctctgggcaactgtagtcacccagactggagacagtggtttgatcatagttcactgcagcttcaaactcttgggcccatcagatcctcacacctcagcctcctgagcagctggcattatgggcatgcaccattgcacatgtctgatttttgactttgtagagatatctccctatgttgcccagggagctctggaacttttggcctcaaatgattctcttgccttggtcttacaaagagctaggaaattacaggcatcagccatattgcccagcctttaattttcctttagctcccacacatgagtaagaatgtgcagtatttatctttctgtgtctgcacttaacatccatcagactgatccacatggccacgaataacaggatttaattcctttatatggtgaatagtattccactgtgtttgtgtgccacagtttttcatccattcatttggtgatggacatgtatgttgattccatacacaagctgttgtggatagtgctacagtaaacatatgaggacagatatccttttgatctattgttttcttttctattgcctgaatacccggtagtggggttgctggatccctcgccagtcccattattagtttttttgagaaaacctcctgttgttctctatagtggctgcactaatttaccttcccaccaacagcatgtaagagtttactgttctctggagcctcaccagcatttgttattttttttgtcttttcaatgacagcaatttattcaaattgaagcaagattatatcacattgtagatttgatttgtatttccctgaggattagtgatactgagcattttaaaatttatttattggctatttgtatttctttttctaaaaaaaagtatagttagatattttgcccagttttaaactcagatttttttactgtgatgttgtttgagtttttttgtatattttgtatattagtccctcattaggtgaatagcttgacaatattttctcctattctacaggttttctcttcactcagttgtttgctggacagaagctctttagcttaatgtagtgtcttttgtctatgatttgttgtttgcctatgcttctgatgtcttacccataaaaatctttgtgcagactaatgtcctcaagccttttccttatatttacttagagtagtttgatacatttgggccttacatttcagtcttcaatcgattctgagtttatgttgttatatggtgttacataggaagctaatatcattcttctccatatggatatttagttttcccagtgtcattcatttgaagaggctgtcctttccccagcgtacgttcttggcatgttcgtccaaaatcagttggctggaaatatgtgaatttatttctgggtgccatattctatggtctttaccccaagaatcattacttcttaaaatgcaattcaaattagcatgaaacatttgcagtttaaggaaaggcttatagcatcagaatccttaatcatagatttcattattttgtgttgttttttgagatagggtctttgtctgtcatccaggcagaagtgcagcgataataattcactgcagccctgaactctgggtacaagccatccttttgcctcagtatcccaactagctgggtctacaggcatgagccaccatgcccgggtaattaaaaaaattttttttttgtagagatgggggtctcactatgttgctctggctgatctcaaattcctggcctcaagtgatctttctgccacagctttttaaagtgctaggattacaggcatgagccaccatgcctaatatagagtgtaatatcactttcaaagtcttattcctagacccatttattgactttggcctaaataactcaatatgatatctctgaaactttttttgacatactgtggggaatgataatgaaggaagggggttagacactttttactaggagataactttgtgccatttaaggaggaacaaaaatgaattatcagaaaaataaaagtaaaatgaagtacaaaaattctgtggcaaagatgatgatagtaaagaatatatttttatgactcatggtagctttaactttgttcttaaaattctgagtaatttaagggttcacatttgaagaatctgctgcattacagataacattttattgcaagtaaatgcatttcaaaatttgctattggttttgtattagattattctcagcctacttcattatcaagctatactattttattcatgcagtttgatgatcttatggcggagaaggaagctgtatcttcaaaatgtgtcaatttggctaaagagaatcaagtttttcaacaggagttattatctatgaaaaaagtacaacaggaatgtgaaaaacttgaggaggataaaaagatgttggaagaagaaatattaaatcttaagacacatatggaaaacagtatggtagaacttagtaaactacaagaatataaatcagagctagatgaaagggcaatgcaggcagtagaaaaattagaagaaatccatttacaggtgagttgtttaaatcaggtaagtttacttgtaatgtgctttcatttatttcactgcaaattatattttggagatatatatatatatatatatatagagagagagagagagagagagagagagagagattacctctcttgtagcaatctgctttgtagagttctagaaaaaaatggtatctgttttttcttttaaatatttaaatttccattattattataacaaaatcaatctttcagagtaatgattctcattatggagtaatttgatgattaagaccagttggcataggaaaaaattgtgatttagaaattatgtgataattatgaattggtcttaagctacagtgttcattgatcactttttaaaactatgaatggattctattactttttatatgaccagattacattaatactagcataattatgatttcaaatttttacaaatcagacttaattctgaattcagttattagttttgatattgctgaaatattttaaacttcatcctcttttttaacatattcaaaaatactctttgaatcgctgactcaaaatgaaaggcaacaaacataataattaggttataattgttttaaaagtgtattcttttcctctgttttaggaacaagcacaatataaaaaacaattagagcagttaaacaaggatataatacagcttcactaaataagaaggaactcacacttaaagatgtggaatgtaaattctacaaaatgaaaactgcttatgaagaggttacaactgagttagaagaatataaggaagcctttacagcagcattgaaagctaacagttccatgtcaaaaaaattaactaagtaagtcaaaacatacactcatagaaaatgaattaagctcattaatttgtttcaaaagcataatttttagtgagatggcttcagattagaaggaagtgaatgctaatttgacaatgtaattttgaaaaataatgttagtaaataattttacctttaaaatgttagtcaaagatagtttttgtctctcctctcattttttttttttttgcttttgtatggctttttttcctgaaaagtctcatgtaattaacctgatctgttagtttttttcactaagtatttttgaagctttataatcaatgaagtgaccttgttataaaattacttgtcagaatttccctaaatagaaatattaatgtgtttaatttacttttcagtggatcacaacctaaatgcaaagtggtacttctactctgggcacaattgtttttgattgtgatctttagtattatcaccagagggtgcctcaagaaagactatttgtgtaacatattcaagatgttacagaaaggcacccttgtgaaatagggaataattatcacaggaatttaaagaagtgtaattcacaaagcggttaaaaaataacaccttgttcagcctgaagcggtgtgtggaaggcagaaagaacatgccccacctccagggccttggtcacagtgttggggactaattgccttcagagatgctttaattctttttgatcaccaaccagacaatctagttctcccctaggagttgttgctctgaattattcctcagtgccaaatgtttaattggtcctagataatgggtgaaatgtacaagagtgaaatctaaaactggtttactaaacacaagtgttcctagattttttttcgttcattttagttttcttaacgtacattaaggagtacaacatgatgttttgatataattatttctagtgaagtggttcttataatcaagcaaatcaacatattcattttcccacattattaccctttaaatacaagtatttctaatggaatcttcagaatcttccaagtacagccattttagaaggcaggaagttttacctgttgagccatacatcactgatagccatttctcttccctgtctactttgtttgaactgctagttcagtagaaatcaccttagaaacaatggtgcttctttagaatgattttaaaattataattccttacaacaggtatgctcttacacatcttctgtgtgaaaacactatttagtgggtaatgtggtttactctcagggtaagtttttaaaaactgcaagtcattaagaatcatttaaggaaaaatgaaatattaagcatttgtctttgctacctttacagatcgaataagaaaatagcaatgatcagtatcagctctttatggagaaagagcaggtgaaatattttctcagcactcttcctacaaggcgaggtcgagagtcaccttgtgttgaaaatcttactagtataggactcaacagaaaatatattccccaaatgcccgtaagaattcctacttcaaacctcagacttcaaataactgccagaactacttgactgaggttagttatatgaccgtttctctttagggtttcatttctctagcgtaattcttgtttataatttggtgaaatactgagttgttctgttgacttttgcatgtgaagtaaagatcataattagctgtgttaacacagaaaggaaatgggaactttacattttttaattccctggagctctcattttcaagagatatccatttgctaactttattcaagaaatgtgactaaactgacatgtttgaaatgtctttaaaacctgcatttaagttaggttttagaaattgcatgttattgcctgataagtgatgatatactttgagatggtctggcttactctctaattgattatagtttagctgtggttcataccacatttttttttctttttttttgaggcagtgtctcactctgtcacccaggctggagtgtcttggtgccatctccactcactgcaacctccacctcccgggttcaagtgattctcctgcctcagcctcctgagtagctgagactacaagcacccaccattacacccagctaatgtttgcatttttagtagagacagggtttcaccatattgaccaggctcttcttgaactcctgaccttgtgatctgcctgcctgagcctctcaaagtgctgggattacaggcatgagccaccgcacccggcccatgccacttttaaagtttctttgcaccagccaggtgtggtggctcatgcctgtaatcccagcactttgggaggctgaggcaggtgtatcacgaggtcaggagttcaagaccagcctggccaagatggtgaaaccccaactctactaaaagtacaaaaaaaaatattagcctggtgtggtggtgggcacctgtaatcccagctactaggaaggctgaggcagagaattgcttgaacctgggagacggaggttgcaggagctgagattgcaccactgcactccagcctgggtgacagggcaagactccatcttgaaaataaaaaaaaaattaaaaaagtttatttgcaccatctcaattcttcccacccataatcacaactgaatgattagcatccactttgccacatatggatgtttattatttagtagaatccaaaataattgcattttatgaattaaacaaaacactaaaatgttcatttccctttttattttaaaagctttgtgcttggccaggcatggtggctcacacttgtaatcccaaaatttggggaggccgaggcaggtgaatcacctgacgtcaggagtttgagaccagcctggccaacatgatgaaacctgtctctagtaaaaatacaaaaattagcaaggcgtgttggcaggcatgtgtaatctcagatactcaggaggctgaggcaggagaatcacttgaacccaggagacagaggttgcagtaagccaagatcataccactgcactatagccttggtgatggagactctgtctcaaaacaaaacaaaaaaaaggtttgtgctttctttacataagagtacatcttctgactataaaaatcctggaaaaaacctaggaaatactcttctggatatcatatttgtcagttaatttatggctaagtcctcaaaagcaattgcaagaataacaaaaattgacaagtgtgatctaatttagctaaatagcttctgcacagcatgagaaactatcacgagattaaacagaaagcctaaaagaatggaagaaaatattcacaaagtatggatatagcaaacgcctattatccagaatccataagagacctaaacaaatcaacaagcaaaaaataaataagaccattataaatgggcaaaggacatgaacagacagttctcaaaataacacacgtaagtggccaacaaacattaaaaaatgcttaccattgctaatcatcagaaaaatgccacacaaaacatcaatgagataccatttcacaccagtcacaatgacttttgttaaaaacaaataataaataaaaacttaaaaaaggatgttggggaggctgtggagaaaagggaacacaaaccgtttgtggcaatgtaaattaattcagctactatggagagcagtttggaaattaagaactaagaatgactgttggatgcagcaaccccattactatactaggggtataccgaaaggacaataaatcattgtaacaaaaagatgtatacacatgtatgttcattgcagcactattcacaatagcaaagacgtggagtcaatccaggtacatccaaggtagattgaaaatccaaggtagattggaaaattccatatataccatggaatactatgcagccatgaaaagaacaaaatcacatcatttgcagcaacatgaatacagctggaatccactctcctaagcaaaccaacgcagaaacagaaaccaaatatctcatgttttcactcatgtgggagctacatattgggtgcacattgtcataaaggtgggaataatagacactgggaaataagaatggggagggacagagtgggccagggttgaaaaactacttcttgggtcctatgctcacaacctgtgtgatgggtttaattgtactgcaaacctcggtatccctcaatatgcctttggaagaaacttacagaggtaccacgttaatttagaatacaaactagaaaaaaaaaagaaaagtttactataagtagagaacagaaatttctttttaagataaaatttattgaagtaaaaaatggattaaacttttataaagggcagagttttctaagaatttcaaagcaatgcattcattgcaaaagatggctttaattacttaatctttttttttttttttttgtgagacagggtctcactctctcaccaggctggagtgcagtggtgcagtcttggctcactgcaacctccacctcctggcttcaagcaattctcctgccttagtatcccaagtagctgggactacaggtgcacatcaccacgcccagctaatttttgtatttttagtagagatggggtttccccatgttggccaggatggtcacgatctcctgaccttgtgatctgcttgctttggcctccccaagtgctggggttacaggtatcagccaccatgcctggccattgtttaacctttgtactaataaaacactacctttctaaaatcatgtatatgcaatagatcaatattaactgcatttttgtcagattactctaaacagcattacacatatacatcctctgttatctaaacttaaaataagtagaaattttattttatttatgtgattatttttctatttaagcaaacttcaagttatgtctagtcactaaaaatactaaaggccacattttgtaagtgatacatgattttcatgataatgtttcttgtttaatttagacattattattatttttacttattttagatggggctggactgtgtagaataaataattagagaaacaaagagaagtacgttgacaaaatttattaattaaatttaggtttattttagaaataaagtgtaaatagcaaatggcattccttttcattcttgggttagtagatactacatcaatatttttttcttacacacatctaatgaaagatgtgaaaacaaaaactttcacagagaagactgtacttatgcaccataaattcatcatgttcctaagcttaaacagttcccaagaagtctgtgcatctctttttcactggctttacagtttcttaagttttgccatcctcatggaactgtcagccagcacactgaaacgattctcagaaaacaaaagcatcatcaagttctcagggtttcggtagagattgaaggccaacagacctaagactcattcagaaatacttagctgagcaataacccttcataagcagtcacttgacaggtgacattttaaatctcctctaatttaatgtgtcattggcttacacttgttctcaggaaaagttccaaatttttcaccatgaaataaaaacacccatgtcaatgtaattcttgccaagttactcagccttgtttctcaccacttactgcactctgccctttgctctagcaccaaactggatggagtggaactctgcagggctcttcctcacctcaggctctttgcctttgcctctttcctctatctgggaagcttttccttgtccttcaggtatcaacctatgttatctcctccaccagaaagcccatgatattgacataaaagtgggtagatgtcccttctctgtgttccagtagtgccctgctgtatacctgtcacggtatctatgactctatatggacattgtctgcctgtctgttttttaggttatagcttatgactgttgagaggtggaccatgccatcttcatcttgtaattccagtgctggttctagtaccttagcatgtggctgttgattacatgaatgaagactgaaaaagttctgatatttaaacacaattagaattaatgccatgtgtaaattattaaatagtaattttgtattgtaaatgtacatacatatttctcattcttattaactctgataaagttctcaagtctttagtttttaaactcacacttagttaactgaagtgttttaggtaaagaacaaaattctttatttttctttccagctgttgctgtattggacacttgctcccatctactttcttctctagaatccacgggtaagccacatctaatgaagagaatatttaaccataaagtcttaaggaaaaattctatgatgatttaaaagattataaaactttattactgggctatttacacattttaattgtttctcataaaatatataacattccaatatttactgaagtaggatatttttgtatcatatgtatgattataatttatagggtattttaaatgatgttttttggcctccttaagttttaagtggatcttgcaaatgaaaaccagtattattgagtttgacatactcaaattgcccaaatgtcagctgtttaaacaaccaagtcatcactgatactttagtaaaggttagtaaaggtcatcgaaggcttatttgcattttacagtttttattacttaggagagttaaggagtacctgccaggtttgtccatgttaatgttacaattttctttttgtagttcaactgtattttgtatggagatactttgaggctctgtaaatatctggttactcctcagaacccactagatttagcatttcatggatgacttgtgtttgaacaattattactatgatggttaccagatgattattttcttattctcttctttgttctacatggagaaataaaaccaataaataagggagaaggaaagctcatgattctgatgctccaattccccaagattaggccagtagtagacattccaagctgactttatgtctctttgatttgtctccattactctgtcggcacttttttactttctggcagaagatgttctaagctcagcttgtattttctctgcgccagctctggaatgagtcattttttttagaagcagaggtggagccactgaggaagcacaggtgagccctccccagtgtgtactcactggtccccaacagaagaaccactgccacatccactgaagtaccaagaaactagcaaagggccttctggctgtctggggagagtcctcatgtggtccctggctgtctcagaggttctggattagtcttcctgtagcctctgtgttctgtctttagatcggggctctgtgggaagggccctgagagacccaacagcacagcgtgccttatctgccaaatgtccctcccttcctcacaccctgacactcaggaatagggtagatggtgtgtccaggcagtgtcaggccacctcactttctcctttgagacgggcccagagggcctttggggtgagtgtggagctgggaacctggagcctgaggccaactgtctctccctgtgtcttggaggaaaggccacgtcccaaaaaaaaaccccagggcctgacctctgggcacacatgcagggagggagggtctatgagctgagggggacattgtaatgagactttgaaccccgttgctccgaggcctggtcagtggaccatggtcagagatgacctggtcatcaggacctggtcatttgggacctgatcagcaggggcctggttagtggcagcctcctcagtaaaggcctcatcagtggggacctggtgacctagtcattggaagcctggtcagtggggggacctagtcagtggtggctttattagtggggcctgatctgttggaacataaacaatgaaaaactggttggtggggcatacacaatatatcacgggcctggtcagtgtggggccttagtggcttggagcctggtcagtgagggcctggtcagagggggctcagtcagctgggtactcgttcatggagaattgttcagtggggggtcggttgagcagcaacctggtaaattgtggtcttgtcagtgggaaccctgtcttgtcaatggggaccaggtcagtggaaaattggtcagtggggtctggcccatgaggcctattaagtgtgggcctggttaggaagacatggtcagtggggacttgatcagtgggacctggtcaatggaggagtggtcattaggggtctcatcactcatcactgggaacctggtcaggggcagtttgtcagtacctggcctgctggccactatgtgacctcaggcaggggggttgtctgtggagcctccttgcctccatctgcagggaaagtgagtcggggcaccctggagggtggctggaaagagaaggtgagaagatgtgttgaatccaatactgcttggcagacctagaactttacaaatgacctgtgttccacctagagagggtgccagccctctcagcattatgcagtgcccctcctctgtccgcatccccaggaccaccatgggtggggagggcagagattggggagcacctatagaggctctaatgctctaaggtgacagtgatgaggaactgggtgcacccatgagtggagaagctaggcctgtccagagaagcaagacaaacacacacatacacactcacacacacacaggcacatatgcatacacaaatacattgcatacacacatgtcagttcaggggatagaggacactgactctgggccctgttgacccaagcagactcccatggtggtgggttgtgtcaccccacaatgtcactgttgctgagtccccatcgcctctgtgttgtggagcagttagagacacacagcagtgtctgtgagtagctctgcgtgaaggaccattttctagatgagaggcacatctcaacacagctcactgatcagattcaggtgagtgggacctgctcttttctcttccttctggcttgggaaaagtcactatcaggtggatggttttggtctctgggcagctactgagggtaatccctgaacactcaccagctgcctgttatgtgctgacagtcatctcattcatcctcgcagcaattccattctgcatctttcctgatcacctccgtgacaacacaggacaaccccatcagggccctgtcaccaggcccagtctagctccatgataaccaagacacaggcccagagacaatcgtcctacattgtgcctgcatctgacaccccttggtaggtagtgaccagcacaacatggaagaagccagggcagcatgcagccagctgctctgcagccccaaatggctcctgggccttgggaagtcactcataaaggggaagctggtcactttgaggtccctgaagggaagggtgaacgtgcatcccaacagccctggcagccagcagcatgccatacatattctcacccaacgtgtgtgacagaggtcccctcctggggcacaagtcccatacctaaagcattctgtcccagtcggacctcatcctgagccctgggaggggagggggaccatgggcccccctgcagcaggctcagaactggggtgtgtgccgcctttggggctccagtccaagcatcggggcttctacagcactgtgggcttctcgggtgccaagaggcagaccacaggccatcttgaggaggactctggtaagagcttccttgtgtacgtggatgatgtccagaatgttggtctggtgtccctgagacagcactaacaggtccatgactgggtccagatcctgcctgggctgatgggcaaagagctcactgacagtgtggaaggcatctatggtgaagtggatctatgttcaagtgcagaaagggcccaatcttgtagatgaaccacacagccagcttctggatgcaggtgcagtgccacattttttgtcacttcctgatgtgccccaccagcactgaagagatagcctggagacagggcaagaggaaggctgagaaggatgagatggtgagtgccagattcttcctggccctgagcccacccccagtgtgacactcaacttttaggagtgggagagcaagattgatggcttcaagtgcttcaccaagaagatggacaacagggcactcaggtcaacttcacagccaatgagtggtggcaggctttgagaaagagcatcagaagcctgacagttcttcttcagcctcagccaggccttggagctggaccaggccatccacttcagtatagatgccttccactctgtcagtgagctctttgccagtcagtccaggaaggacctggacccagccatggacctgttagtgctgtctcagggacacaagacaaacatcctggacatcattcacatacacaaggaagctcttaccaaagtcacggagaacagacaacatgtggcagaagggaagacagaggtgcagaggctgatggagtcattatcacaggaacaggatttctttggccactttggctgaaattcaccacttccatccaattcactcaagtgagagacttgaaatcacagatggagcatttcttgcaacaagagatactattttttcaaaaagtcacctaaaatttgatagtgttgaatgactagctattcgagtgtggactttttccagttcacgggtactttctacagcagaatgataacagtatcaaagagctggtgccagctatcggtggtagtacaaggatgactttgtgctcaactgaaacccagctgaatatagaattgtgtacgaaagtgttaatatggtgatagaatagaaacagtagcaaatgaactaaatcatactatgaatgcctacactaccattataactttttgaagaatgataataccacttactttattgccttttgaagtaggaatattttagtggatatcgtatagatctgaaaccctataaagaatcccaaagaagctggctggataaagcctgctatggatgtctttatactcaaagactgatgaggcaattcgaatatgtgtccctgtgtccccaccaaatctcttgttgaattatgcttcctaatgttggaggtggatcctggtataaggtgattgaatcatgaaggcaaatttctcatgagtggttcagcaccatccccttggtactgtcctcacaatcatgagtgacttctcgtgagatctggccactgaaaactctatatcactccctactctccgtgatttcctcttgccatgtgagacaattcactctttcattaccttgcacaatgattgaaagatttctgaggccccccagaagcagaagcactaagcttcctgtccactctgcagaaccatgagccaattaaacctctttttcaagataaatcttaccaaaaatggcaaatgaggactggagcactgctataaagatacctaaaaatgtgaaagcaacttcggaactgggtaatgggtagaggttggaagagtttggagggctccaaagaagacaggcagatgagaacatttttggatcatcttagagactggttaaatggctgtgacaagaatgctgacaaaaacatggacagtgaaggccaggctgagggggcctcagataaaaataagaagctttctggaaaatgtctctcttttggatatggaaagcttacacaatgcctgtaccatcattgtaccttagacgcagtgaacttgctttttatttcagagacttgtaggcaaaagagaatgtagccttgacccagatgagactttgcactttgtaactttgagttaatgctgaaatgagttaagactttaggagactgctggcaaggcatgactgtatcttgcaatgtgagaaggacatgagatttgtggggtcagggacagaataatacggtttttctctatgccccttccaaagctcatgtgaaagtacactccctaatgttagagtcggggcctaggtggaaaaagctttaatcataaaggagtgggagtggatccttcacaaatggcaaagcgccaagcccttaatgccatcctcctgatagtgagtgagttctcatgagatctagtagtttaaaaggctgtggaacctctttcctctctctgtcttgttccaacttctgccatatgaaacatgtcattgccgcttggatttccagtgtggttaggaggggcctgatcagtgtgggcctggtcagtggacctaggtcagtgaggactatttagtgggatagtggtcagcaggggtctgcttagagagggtctcattagtggggtctagtagtgggggttttggtgagtggggacctattggctgccagttgtttggtgtctggtcagtgcaaacctgggctgtggggcttgatcagtggagacctggtcagctggggcttagtgctggcctggtcagcatgggctggggcactggtgaccaggtcaaggggtgctattcagtggaggactgggcacatgagacttagtcagcagaccctggtgggcgtgtcctcatcagtgaggcccttgtcagtggggccctggtcagggcagccttgtcggtgggacctaatctgtattgtcctggtcagagaggacttggtcagtggtgacttttgtagcaccggtctacagggtgacctggtcagcggggatctcagcatttggtgccggttcagtggggtctactcactagggtcccagtcaggggcatctggtgacataaggcctcgttattaggggcctgatcagtggcaacctgttccctggaggcctggtcagtggggcctcatctttgggccagggaatgagttcatgatcagtggaacctgatcagtgaggccttgtcaataatgacctagtcagtgaggacttgtcagtaaagacttggtccgtgaggccctgtcagtgagtccttgtcagtaaggtcctggtcagtggagtccttgtcattgtgtgcccggcagtgggggccttgttactggggcctgatcatgagagtctaatcagtgagggtgtcatcagggaggacctgatgtgtggggtctggtcagcagggacctggtcaatgtgggctgctgagcactgcttggataagccaggtgcattgtgcattattgaaggccctgtggacagctgggatagcccagtgatgcccaagggcctagtcaaaagtggacaaagcacgtatttggatggacctgggagatcctgctcagagattctgacaggacaaaggtaaaggaagggccagagtggctggagagatggtcacagtctatgggctgcacaggatggaggaggccggggaacaggcagggtgggcagttggggttcagggagaggcaggtgcatgctgggaggtcagaccctgtgagggctttgggggcgtcaggttgggtaggctcaaggcactctcactcacataggattccagaccactgctacaaggctctgagtgtttgtccctcacataagattccagaacactgctgccattgtctgaatgtttgtcctccacataggattccagaagtctgctgctggggtctgaatgtttgtcccccatctaggattccagaacactgctgcgagggtctgaatgtatgtccctcacatatgattctagaacattgatgctagggtctgtatgtttgcccttaacatatgatttcaaaacactgctcctggattctgaatgtttgtccttctcataggaatacagaacactgctgctggagtctgaatgtttgtcactcacatagaattccagaacactgctgcgaggatctgaatgtttgaccctcacatgggattccagaacactgctgcgagggtctaaatgtctgtccctcacataggtttccagcacaatgttacgaggttctgaatgtttgtccctaacataggattccagagcactcctgctgtgctctgaatgcttctccctcacataggattccagaacactgctatgagggtctgaatgcttataactcatataggattccagaacactcctgctgtggtctgaatgtttgttcctcacataggattccagaacactcctgccgtggtctgaatgtttgtccctcacataggattccagaacattcatgctggggtctcaatgtttcccttaacataggatttcagaacactgctcttggggtctgaatgtttgtccctcacataggattacagaacactgctgctggagtctgaatgtttgtcagtcacatagaattccagaacactgctacaagggtgtgaatatttttccctcacctagtattccagaacactgttgcaagggtctgcatgttggtccgtcatataggattccagaacactgctgctgtggtctgaatgtttgtccctcacataaaattctggaacactgctacaagggtctgaatgtttgtccttcacataccattccagaacactgctgccgtggtctgaatgtatgtccctcacataggattccagaacactgctactaggttctgaatgtttttcccacacctaggattccagaacacttctgctggtgtctgaatggttgtccctcacatatgattccaggacactgctatgagagtcttaatgtttgtccttcacatagaattccagaacactgctcccgtggtctgaatgtttgtccctcacatagcattccagaacactgctacaagggtttgaaagtttgtccctcacataggattccacaacactactgctgtggtctgaatgtttggccctcacataggattctagaacactccagctggcttctgagtgtttgtccctcacataggattcctgaagactgctgctgtcgctatagtcgttgagagtgtctgaatgtttgaccttcaccaaacaccaaatatcctggccctttagtcttgtactttccagcctccagatctgtgaacaataatctctgttgtttatgaattactcagtctgaagtattttgttatagtagcctaaagagactaagagagcatcacctgccctgtcacctcatcaccgcattactgaagctatactaacaacagtcacttttagtgggtacttcatgcatcagaataaagggaaaaaattgcaaggcatactaaaatccaaaaaaagaaaaaaatacaatttgtgtcaacagagcaagcttcagaagcagacaaagatatgatcttggaatttttttttaaacctctggagaatatgctaagggcctaatgaatgaagtagacagtattcaagtgtagatgggtaatgtaatgagaaagacagacatcgtaagaactttcaacataatgtagtgatgaaaaacgtggtaaataactgaagaatacctctgatggcttattagtagactggactcagctgagtaaaaatctctgagcttgaggatttatcatcagaaacttcgaaaactaaagaaaagaaacactgaaaagaacagaagatgatattcaagactgtgggacaactacaaaaggtgaaacagtaatgagaataccaagaggagaagaaatagaagaaagttctgcaacaaccatgtctgagaacttccagtattaatgtcagacaccaaaccaaagatccaggaagctctgagaacaccaggcagaataaataccaacaacctacacttggacatataattttcaaactatatgaaataaaagataaaggaaaactctgaaagaaaccagaggtggggcagaaaacaccttacctacagagacacaaagataagaactgcattcaacatttcagaaactgtgaaagtaagaagacagtgaaatgaaaaattcaaaatgttgacagaaaaaacccaccaacctaagtttctgtacccactgaaaccacccttcaaaagtgaaggagaattaaggccttcctcagaaaaataaaaattcaagaaacttgttgccaggagacctgtcttgcaagaaatgttaaatgaaattctttagggaaacaaaagatatataactgaaacctggatcaacatttttttaaaaagaacattaaagaaagaattgtggtacaataaaaacctatgtatttattcttaattgatctaaccaagaagatcatagacaataacaaatacagatatattatgtatgcttatatacaattgaaatgagtaacactaatacaaggaatggaatggaaggatggtagggaggcattgtggtacaataaaaacatgtatttattcatagttgatctgaccaataagtttgtagataataataaatacacacagatagattatgcatgcttatacacaagtgaaataaggaacaataatacaaggaatggaatggaaggatgggagggaggaatcaggtgttttctttgttaagcaggtagtcacccgtgaagtgggatagtgttatctgaaagtggacttgaattggttgtaaatgtatattgaggaattaggtgtgttctttgttaagcaggtagtcttatttgtgggatagtgggatagtgttatttgaaagtggacttgaattggttgtaaatgttactgaggaattaggtgttttgtttgttaagcaggtagtcttatttgtgggatagttggatagtgttatttgaaagtggacttgaattggttgtaaatgtatattgcaaattctgtggcaactagttaaaaaaaagttttaaaaagagaagtatgtactaagaaagacagggaaaatggagtcatctaaaatcatcaatgaaaactgcaaaaggcagaaaaagagtggtagacaaaagaatgaagactgaggagaatgaatagaaaacagtaacaaatatagtagatattaatccaatgatatcaataatcactttgaatgttaatggtatgaatgtaccaattcaaaggtagagattgtcagagtctatcaaaagacagacacatcttgtttcactgcactttgctttattgtgttttgtgaccatgtgttttacgtattgaaggtttgtggccaccctgcaataagcaggtctcactggcaccattgttcctacagcacgtgctcacttcacgtctctgtgtcacatttcggtcattctcacagtattttaagatttttattattgaatctgttgtggtgatctgtaatcagtaatctttaatgctactgttgtcattgttttgggaaccacaaatcacaccaggataagacagcaaacaattgacaaatgcgtttgttctgactgcccaaccaacgggccatttctctttctctttttctcaggcttctttttattaatattaaaatgtggccaattaataaccctacaatagcctctatatgttcatgaaagaagagttgcatgtctgtcactttaaaccaaaaggaagaaataattaagcttagtgaggaaggcatgctgtaagcaagacaggccagtagctagacctcatgcaacaaacacttagccaagttgtgaatgcaaacgaagtgttctggaaagaaatttaaagtactgctccagtgaacacatgaatgataaaaagctaaacaatcttgctgctgttatgaagaaagtttaattggtctagatagaagatgaaaaaaaaacaaaaaacattccattaagcctaagcctaactctctttttacttttttttcttttttttgagacagagtttcattcttcttgcccaagctggagtgcaatggcgtgatcttggctcatcgcaacctctgcctcccaagttcaagccattctcctgcctcagcatcccaagtagctgggattacaggcaagcaccaccacacctggctatttttttgtatttttagtagagacggggtttctccacattggtcagactggtgtcgaactcccgacctcaggtgatctgcccgcctcggcctcccaaagtgctaggattacaggtgtgacagccaccgcacccggcctctcttcaattctatgaagacttagagtggtgaggcagctgcagaaggaaagtctgaagctagaagagcttgtttcttgaggtttaaggaaaaaagtcatctccataacataaaagcgcaagataaagcagcaagtactgatggaaaagctgcagaaagctatctagaagataactgattaagatggcaacactaaatagatttgcaatggagacaaaacagccttctactagaaggagatgccatctaggatgttcccagctagagaggagttgatgcctggctttaaggcttcaaaggacatgctgactcttttgttaaaggctaatgcagttggtgatgttaacttgaaaccaatgatgatttactattctgaaaatccaagggccctgaagaattatgataaaacacagctctgtctgtactctacaaatgggaacaaagcctggatgacagactatcggcttacaaatatggtttactgaatatctgaagcccactgttgacacctactgctcaagaaataagattcctttcaaagtattaccgctcactgacaatgcccctggtactcaagggcttttacagagatgtacaaagagctgaatattgttttcatgcctactaacccaacattcattctggtgcccttggatcaaagaataatttcaactttcaagtcttatcacttaaaaatatatttcataaagctataacttctctagaaagtgattcctttgatggatctgggcaaaataattgaaaacctactggaaaggattcaccattctagatgtcattgagaacattcatgatttaaaaaataagatcaaaatagcaacattaggagaagttggggccgggcgtggtggctcacacttgtaatcccagcatgttggcaggccaaggcacgtgggtcacgaggtcaggaatttgagaccagcctggccaacatagtgaaatcctgtctgtactaaaaacacacaaaaaattagctgggcctggtcgggggtgactgtaatcccaaacacttgggaggctgaggcagaattgcttgaacctgggaggtggaggttgcagtgagctgggatcgcatcactgcactccagcccaggcaagacttcatctcaaaaaaaaaaaaagagagagagagagagagaagttgggaagattattccaaccctcacagatgacacaggggttcacgacttctgtggaggaggtaactgcagatatggtggaaataacaagagcactagaatcagagacagagcctgaagatctggcgagactgcagcagcctccggagaaaacgtgagtggatgagttgcttccaaggatgagcaaagaaagtggtttcttgagatgaaatctactcgtggtgaagacagtgtaaacaatgttgagatgacaacagatttagaataaacttagttggtacagcagaaggagggcttgacaggattgacacaatgatttacaataatacataaacttagttggtacagctgtacgaaggtttgacaggattgaatccaatttgaaagttctactgtgggtaaaaagctatcaaacaacatcgtatgctacagataattcttttgtgaaagggagtcaattgacacagcaaacttcaatggtgtcttattttaagaaattgccacagccaccccaacgctcagcaaccaccaccttacattaaggcaagaccctccatcagcaagaagactgaaacttggccaggtgcagtggctcacacctgtcatcccaacaccttgggaggccaaggtgggtagattgcttgagcccaggaagtcaaggcaacatggcaaaaccccatctctacaaaaaaaaaaatacaaaaattagctggtcatggtggcatgtatctgtagttccagctagtcaggagtctgaggtgggggtttgattgagcatgaggttgagactgcaattactctagcctgagccacagagtaaaaccctgtcacgcacacaaaaaaagattgcagctttctgaaggctcagatgactgttagcacttgttaacaataaagtatttgtaaattaaagtgtgaacactttgtagacatatgctattgcacactttatacagcacagtataaacatacttttacatgcactggaaaaccaaaagaaattgtataactcactttattgcagtggtctggaaccaaacccacatatatctctgatgcatggccgtcctgtattgtacacttaaaataaaacttaagagggtatcttttaggtgaaatggtcatctcatttttttttttgagacggagtctcactctgttgcccaggctggagtgcagtggcacgatctcagctcactgcaagctctgcctcccgagttcataccactatcctgcctcagtctcccaagtagctgggactacaggtgcccgccatcacgcccagctaattttctgtatttttagtagaaacggggtttcactgtgttagccaggatggtcttgatctcctgacctcgtgatccacccgcctcggcctcgcaaaatgctgggattacaggcgtgagccaccactcccggtctcattttttaaaaagggtcagaatgagaaatatatggggagtgatggtcaagtttacggcattatttgttgtgatgagtcctggggcgaatacttatctctaaactcattaagatgtatatattcggtgtcacacacctgtaatcccagcactttgggagaccaaggcaggtggatcatctgaggtcaggagttcgagaccagcctggccaacatggtgaaaccctgtctgtactaaaaaaatacaaaaattagccgggtgtcggggcgcacgcctgcgatcccagctactcaggaggctgaggcaggagaattgcttgaacccgggaggtggaggttgcagctagctgagatcgtgtcactgcactccagcctgggcaacaagagtaaaacctccgtaacacacacacacacacacacacacacacacacacacacaaaggtatatattaaatatgtgtaatttttgtatgtcaaccacaccttagttttattttattttattttatttgagacagagtctcgctctgtcacccaggctggagtccagtggtgcaatctcagctcactgcaagctccacctcccaggttcacaccattctcctgcctcaacttccggagtagctggaactacaggcacccgccaccacgtccggctaattttttgtatttttagtagagatggcatttcaccgtgttagcccggatggtctcgatctcctgacgtgatctgcctgcctcagcttcccaaaatgctgcgattacaggtgtgagccaccgtgcccagacaatttttttttgagtcagagtctcactctgtcaccaaggctggagtgcagtggcactatcttggctcactgcaacctctgcctcccatgttcaagcaattctgctgcctcagtctcctgagtagctgggactacagatgcatgctatcacgcctggctaattttttgatttttaatagagatgaggtttcaccatgttggccaggctggtctcaaactcctgacctcatgtgatctgcccacctcagcctcccaaagtgctgggattacaggtgtaagccactgcacccggcaatttttaaatatatataattaaaaattaattaaaaaaggtatttgcaagtttccgttttgttatatacttattattctttatctttatgtcaggttgctgtgtcaatacacttaggagatcatagtttctaaattgaaatacaaataaatatgtctcaaattttttcttttttctttttttttttgagatggactcattctgtcacccaggctggagtgcagtggtgcaatctcagctcactgcaacctccgcctcccagattcaagtgattctcctgcctcagcctccagagtagctgggattacaggcacccgccatgacactcagctagcttttatatattttttttctatttttagtaaagacagggtttcaccatgttggccaggctggtctccaactcctgacctcagatgatcctcccacctcggcctcctcaagtgctgggactacaggtgtgagccactgtgcctggcatggaatttttttctaaaatttacatttctgagttaagaatgcttaaaatattataaaaacagaagcacaattcattatgtgtttcattaattacctctattgaaaacaacacaattatattacaataggacaaaaaaaaatgtttaagcaaatgaaaacaaaaccatgacatacccaaactcaggaggaggcaacaaaggcagtgctaaagggaagcttacagccgcagatgcttaaattaaaaagaagaaagatctcaaagccatgctaaagggaagcttatagctgcaggtgatcaaattaaaaagaagaaagatctcaaatcaataacctaacattacacctaaagggaaaaaaaaaaaaaaactaatgacaaaccaagcaaaaggaagaaaataacagattagaacagagataagcagaataagaccagaaaaaaaggaaaaaaaaaaccactgagtttgtttttttaaagatcaataaaaattttaaaactcacagctatattaagaaaaaaagagaaatctcaaatactaaaatcataaataaaagaagtgacagtacaacagattccacagaaatgaaaaagattacaagagactaatgtaagcaaccatatgccacagaactgggcaacctagaaaaatttataaattcctagaaacacaaaccaccatactgcatcatggagaaataaaaaatccaaagagacctgtaactagtaagaagattcaaccagtaatcaaaaaccccccaaaaaagaaaattccaggtccagataacttcactggaaaattttaccaaacatttcaagaagaattaatgccagccctttgcaaaatattccaaaaatgttcaaaaaccagaaggggacattccaatccattctatcaggtcaacatttatctggttccagagccagatgaacaccttttgtaataaaaacactcaaagaattagtaatatatggaaactcctcagtaaataaagattgtacatgaaaagctcacagctaacatcatactgaatggtgaaaaactaaaatcttttcctctaggatcaggaataagatagcaacatcttttcctgccacttctattcaccacagtactggaatttctactcagaataattaggcaagagaaagtaataaaaagcatgcaaattggaaaggaaaaagtacaaaattttgttcacagacaacatgatgtaatgtgtaaaaatcctgaaattccacaaaatactggtagaataatgaaattcaacaaagtttcaggatacagtaacacacacaagtcagttccatttctataaactaacaatgaacaatctgcaaataaaattttaaaaagaggccaggtgcagtggctcacagttgtaatcccagcactttggaaggccaaggcgggtggaccacctgaggtcaggagttcgtgaccagctgggtcaaccccatctctaatataaatagtaaaactctatcgctattaaaaatacaaaaattagctgggcatagtggcagacacctgtagtcccagctacttgggaggctgaggcaggagaattgcttgaacttggaaggtggaggttgcagtcagctgagactgtgccactgtgctccagcttaggaaacagagtgagacaccgtctcaaaaaaaaagaaagaaaggaaagaaagagagagaaagaaaagaaaagaaagagaaaacaaaagaaaagaaatttttaaaaagaatgacatttggctgggtgcagtggttcatgcctgcaatcccagcagtttgggaggccgaggtgggcagatcacctgaggtcacaagttcaagaatagcctggtcaacatggagaaacactgtctctactaaaaataccaaaaagttagctgggcatggtggcgcgcacctgtgatcccaggtacttgagaggctgaggttggagaatcgcttgaataaggaaggtgcaggttgcagtgacctgagatagtgccactgcactccagcctgggagacagagcaagactccatctcaaaaaaaaaaaaattatatttacaacagcattataaaaattagaaataagcttaaccaagagggcaaaagatttgaacacagaaaactacaaaacactgttaaaagaaattaaacacaaataaatgaaaagaaaagctgggtttgcaaattagatgatttcatcttgaaatgatgtcaacactactcgaagtgacctagattcaatacaatccttataaagattccaatgacatttttgataaacagaaaaacctatcctaaaactcatatggaatctccagggcccatgaataggcaaatcaatcttgaaacagaacaaaattaaaggtctcaaagcaattacaaaactgcaataagccaaaaaaaaaatgtggtcatggcataaagacactcttgacacacttatggaccaacacaacagagacctcagaaaccaaccctggcatatatggtccgatgatcttccagaaggatgccaagaccactcaatggaaaagcacagtttcttcaacaagtggtgatgggaaaattgtataactacatgcaaaacaatgaagttggactcttaccttacaccacgttaaaatcaattcaaagtgaattataaacctaaatgtaaaactagaactatcaaactcctagggaaaacaaatttggaaaatgctttatgacgatgaatttgtcaataatttttaggatatgacattaaaagctcaggcagtaaaagcaaaaatatatcaaacctaaaaacttctgtacctcaaaggtcacaaccaacagggtaaaaggcaaactgtaaaataaaaaaaaataccagttgagtgtcccttatttgaaatgcttgggatgtgtttcagattttgtaatatttgcattattcttactggttgagcatctcgaattcaaacacctgagtctgagatgctccaataagcatttcctttgagtgtcatgttggcactcaaaaagtttcagactttggagcatttgggatttcagatttttggatcagagacattcaacctatagttgcacatcatgtatctcataagaagtgaacattcagaatgcgtaaagaactcctacagagagactaccagaagcagagaggagcaaacacattttcacactagggaacctgctatctctcctggattccaattagggcagagtaagtgcttgttctctgccaatccaggattaggccctgcagctgcagtgaaaataatcacagaagaaaactaagaaataaaaaatggagaaagtgagacatcaaactagaattactagaaacccccaggaagaaggaaaaaaaatccaagaaaacagaaaaacaatcaaaccagttaattaaaccttggtgtgaccagaagatcagggtttcctaaaggagtggaaatttattgacttgaaggcgatttattgattactgatttgaagaggaagaaaaccatgaatggtctaaagcaaaagcctagtgtctgaagaagtcagtagggtgaaaacaagagctggccagaatgtccacagatggtgacaagtttgcaaagcctttactagactacttgtgaagctaactagaggccaaggagccaacactgcccctgtccttacagagagaccctacacaggattcccagatatacatggaaggacaacatcttatcaggtcctctctgttcagatgtggttatcattccaaataatgagctccagccccaagactgttccatcctcaattgctttgagtgggcaatgtaggctctccacacacgagctacatgtaggttccttgggtacccagatgggagccgtgaaacataaaccctccatggtcaggtcagtatctgtttcctgcctttttcccagcaatccccaggcctcagcagcagtggtctacctctgctgattctcattcagaatctaaacttagaaacaattagaacctagacccgaattctacctgaaagtaacagaataacataatctataccctgcagcatgactgtttgcccaacgtaatgaggatgaactgagagataatgaatgatcatgaccctggcccaagtaacaagaatgaactgtgagataaatgaatgctcatgaccaaaaaacccagctacaacacaacaaaataaagtgattaaaaaatggacaaagaacattcatccaaagatgcaaagatgatatacaaatagccaacagatacatgagatatatgagaagatgtgtaacttcactaatcattagagaaatgcaaatagaaaccacaatgggacatcacttcaaacccaacagaaagtaacaagtgcaggtgaaactgaaacacttgaacactgttggtggaaatattaactggctcctcaaaaaaataaaataaaatgaccatatgatccagccatccaacttctacagagacagaataactagtagcaggacctcaaacagatatgtgcacacctgtgttcacaggagcattacatagccacgaggtggaagaaaccaaaacgtccatccaggaatagatggataaacaaaagaatatacatatatatatatagagagagaaaatatatatatatgaagaaatattattcagccatagaaaggaagaaaatcctgacacatctgcacataacatggaacctacttaaaaaacaaatattatataaccctaggtatataagccaaatttttagaaacacaaagtagaatagtacttgccaggaggtggaaggaaggggaaattaatagttgttgaatgggtatagagttttctaagataaaaaaaaatctagaaatctgctacacaacaatgtaaatattcttaactctacaaaactgtatacttacaactggttatgatggtaaattttaaggtatgtgtttgttaccaaaattcgaaattataaattatttataaaaaatgatcttttttgacacacagtcttactctgttgccctggcaggagtggaatggcatgatcacagctcattgcagcctcaacctcccaggctcaagcaaccctcccacctcagcctcccaaatagttaggactacaggtgcacaccaagatgtcaggctaaattttggtttggttttttgtagagagggttttgccatgttgcccaggctggtctcaaactcctgggttcaagcaatccacctcccttggactcccacagagctgagattatgagcataagccaacatgcccagcctataaaaaattatttccaaaagccaaaagattaatcaaactggaatatttagaaatatttaacccaaaagaagttaggaaagaatatatagaagatcaaaagacagacgaaggccaggcatggtggctcatgcctgtaatctgaacactttgggaggccaaggtgggtagattgcttgagctcagtagttcaagaccagcctgtgcaacatggcaaaaccctatctctacaaaaatataaaaattagccaggtgtggtgccatgcacctgtagtcccagctactcagggggctcaagtgaggattggttgggcctgggaggcagaggttgcagtgagccaagattgcaccattgcactacagtctgggtgacagaacaagaccctgtcttaaaaaaaataaacaaacaaatagaaaataagtagaaaaatggcagacctaaatccaaccttagcaatgattagttacaatgtaagtggacaaatactctacttaagacagagactgccagacctgagaggaaggcaagacccaacaatatggcatccacagagacacaatttaaacacaaagacacaaagtatgagaaaaaatatgctatgcagattaaacataaaaatatgctatccagacactaatcataaaaagcttcaacagagatgttaacactagatgaaagaggcttcagaacaaaatatatcaccagaaataaacagggtaatttaataaaaataaaagaatcagagaggatgatgttacaattataaattgtgcctcaaagtgcacacaaactacacacacacacacagagcctcaaagtatgtgaatcaaaaacaacagaacaaaagcaggaaattgacaatccaaaattatagctggtgaattaatactgctctctcagtaactgacggaacaaccagataaaaatataggaaaaatacggatctaaatgacaaaatcctgacccaaatggtacttggcagtgccaagatagactgtatgtcgatggattgagaaaaggttcaagcctgaaatagtatacaaaggatgttgtctgaacacttgaaattaaattagaaaccaacaacaaattgatatccagaaaagcctcaaatgtctgaaaaccaagtaataaactttgaaataccctgtgagtcaaaaaagtattcacaaggggaactggaatgtatttggaataaacttgttataaaaatctcatttctggtagactaaaggtgacaaattctttcctgctcctctctctgtgagaaccaattccccttaaaccttgaccagactacagacttatttggccaacagaaggtgacaaagctggtatttggggacttcagaagccaggctgagaaaacagaacacttacccaggagaaagccagtcaccaggcaggaaatcccactcccctgagacctcatgatggaaaccacaaggccagtccatgactagctacacgcattgacatcccccactgagcctccagcaacaccgactcccaacaactagtgagcctccagcaacatccactcccaaccactagtgagccaccctgcacaccaccccactgtgctttcacacaatccagcttggctgcaactgtgtgtgagatgagctggccaccaagactctctaagccaaaaaacaagtaataatgagttgttttacttcagaatagataactggaacagaatatggcagctggaaatgagctgctgtggtaatcagaagctacaatatgtgacacgactgtgaggctgacctgtaactgggcctcaaggagaccattcatgcaacctggaagggcatcaagactcttggtcagggcctgaaggacggtgagaaaatgtcattggaaactggagaaaaggtctgagagttacttgctgagggactgtgggaaaactatggccacaacatggaaactgaaagggcactgcaccatctcagggatctgcctaaggagacatctgggaagaacatggaaagtgctaccagcctcccctaactgtcactgaataaatatgacaggagagggacatgatctaaagaagaaggttcagttttcaaacagaatttagagaaaatataaagaaataatttcttgtctcaaaaggccaaagtaaaaaaaaagaaaagaaaagaaaaggaaaaaaatgaaaaagaagccattgaataccctattgaccataagaaaaaggcagggaaagctggtcaacggcaacccaggcactgaaggaaaaagaacatggagaatgacaaaagcccagagggaggagtaaaaggacacaaacaccattctcagggaccaggactgggcaccgttttcagggaccaggactgggcactaatcacagaactgtaacaggcgccccatgggaatgaccaactgttagacggggcctgcagggcagtacttccctcttgcctcccaccaaagcttctaaagggaaatgtcgactgttttcacagcagtcccctcactgcggctgagtttgtgggctcagatgatagctcacaacaacctgattcagtccccactgtggctgtgtgtggggggtcagatgacaggccaccacaacctgattcagtcctcactgcagctgagtgtgtgtgggtgcagatgacaagccaccacaacctgattcaggattcagttgggctactagccagtgccataaggaaaaccattctggggctctttagaggggcaaagcataatttgcatgtgggagaaacgttaatagtttgtggccagaggacaagctgtggtttattaaagactgctgcaggttcctactatgcttctcatcaagaggtggaatctaatcacctttcccccttgaatcatggctggtctcagtgatgagtacaactggacagtgtggcaggagagatgctctgggacttctgagggatgatcatgagagaccttacagcttctgcctgggcctcttggacacacaccctgggagaagccagacaaacctgactacctgatgctaccagactggaaggaagtccgtgctggccacaaagagagggctgggtgcctgctccatgttcccagccactagagtccttctgggtgcctgcttcacatctccagccactagagtccttccagatgagaccagggacatcatgaagcaaccaacccacaccgctctgtccagtgtcttgacccagaaaattgtgacatgtaaaaagaataaattcctggtttaagccagtaaggttacgggtacattgttacatctcagataattaaaaccttgaaaaactcatgagagatcacaagtagaaccttgatctgaaacatggcatgtggcgatttatattgagtattaggttaaaaatgcaagaatggagcatagttaatattttacattaaagctaaaaccataattgcctacttaaaattttcagttaattaggttgtcactttttgttcttaaccaagaaatcaactagttttagtccataaacagttagaactgatgcacacatccgtttttccttactcattttaaacagctatctgaaataggaagtgtaatgtaatctttaaagaatctgaaaacatgacagaaatgtttaaactataaacatatattgtatatgttagcatattgtatacattgcatattaacataagctagaatcattgacataaatttatataaacaaaaggtataaaatatgataatgttcttcttgttttttgtctttgcatatttctttattggcccttgtcaaacgtgacccactaactcctgaatgctttgtctctccccatggattcctaaggatgtcaccacagtgttggccagatgcacaggtcacaggggactgaaactcatcaccccacaaacataccattcaggttttgccaagaatgacactgtaaatgtaacaaagcttctgtgcttgttagtgaacaccaactcagctcctctcctgtattcagaaatcaggatgagatgaaaacaacaagcaggccaggcacggtggctcaggcctgtaatcccagcactttgggaggccgaggtgggcagatcacctgaggtcgggagctcgagaccaccctgatcaaaacagagaaaccccatctctactaaaaatacaaaattagccaggcgtggtggcaaacgcctgtaataccagctactcaggagctgaggcaggagaactgcgtgaacccgggaggtggaggctgcagtgagccgggatcacaccactgcactctagcctgggcaacaagagtgaaactctgtctcaaaagaaaaaaaattaaaaataaaagaacaaggaaacaaaagtaacaaggcttgacaccagatgagcctgaatctaagcaagaaaagcccagaaaaaatcccattttgggtcactggctgcatggtagtaataccatacacataagggaagagaggaggatgtggctttcactttgaatttttttagcttaaggtaacatttgcgtagctacaaataagaattcaacagagagttaaacctatgatggaaagattgaaggggtccaagctgtagagaaacaggactgcaaaccacaaagagcagaatcagtcaaggagagctgcagggcgggatgaacagggaccaatggaacatttggacaagctgttgagaagaaaggaaaattcagagaaaaagaactgtcagtgaggtaataataggaactgttacagtgaactaaatatggcctgggaaggactctgtacttctagatttgagtccctgtggacaaactgcaacctaacttaataggtagaaagactgataacctaactttggagtatgcacctgtaactatagctgagtcctggccaatcccaacagccaaacttctgccactcacacactactgagtgttcagctgtgttcaaataaggcaaatgctgagcactgtaaccagtccagttgtttctggacctcactgctgagaactgtaacggacccagttgcttctggacctcactcctcacttcagatttctgtacatcacgttccctttattgtctataaatcttccaccatgtagctgtgctggagtctcaccgaatctgctgtgattctgggggctgcctgattcgtgaatcattcattgctcaattaagttcctttaaatttaattcagctgaagattttcttttaatagatggtgtcagaagtgggatctgtgggagcaggactgctagggcctccggagctatagtgtggtgagcagtgttgctagggcttctaatgaccctcaggagtgctgaggtacaagaaaggcacctgcaaggaccgctctatgatggcagcagtggcccatgtggagcagttgctacagagacactggctgcagtggggaggagtggctggggctgtgaactcctcaaagttagtgggagccaggaacaggtgagagacccaccccttctaaattggcaggcaggagccccaccctcccaggcacagctgcagccatccacccatgacagcaagcccgggcatctttgcactctcagaggcccagcaagcccccctgcccccgtaggcccagtcatacctgctcccaccacctggcatgtctccgctcccagagcccactccaacttcggatccaaattgaggttgaacccaggcacagtcgcaacccagcccagtttgtgcaagctcagggcagtgctgacatgccagccccctgccacctcggccccctccacactttgggaacggatgagcacaggagggacgttgaggtggggctaagagtggctcagcactggcttgaaggcactcctcagctcgaaaagcctgggcactgtgggcatagctaaccaccatgcatctctctcagctgctgagagctgaacagacattgggatgacctgcctgctgaaaggagctacccactgcacgtctcctctgagctgtactgttgctcaataaagcacctcttcaccttgctcaccttctacttgcccacatacctcattcttcctggactcaggacaagaacttgggacctgccaactagcagggctgaaagaggtgtaacataaacagggctgaaatgcaccccttgcttgccaaattgcaggcaagaagaagagaagagagaaggagagaagagctgtggcccttcagggagcccagacctaggagctccccaagccagggctgtgacaccttatttggggctctgcagttcctgcatctcgaagcttccaggcaccgctgcattccctgatacccacagtggaagctgtttgcagtcagcctggtccagctgcagcctcacagggagctggcacctgtggcggtgcctggagctgcccaccccactgcagctggcatgcttggctgtgtgcagtggccagatcccatgctcgcttgctcacacacccttcactgctctgtacccagctcacccttggcaggtgtgggatccagaccactagcatgagccaagtggacagaacgaacccagtgggcccgagcaaaacacaggtaaaggcgccaccagccagaggtttcaggcagaaaagtgacgcctcaggattctgtaacacttgtgccctttgacctctcagagcatctggggatcgtggtaaattctctctcggatttcagagctccatgaatttgtgttttgagctgagtttctctgagcaaatttctgttccaaactgctatccagccatgactggctggatgttttagaagttatgacagaaacgggaccgggtccaggatcagatttgatccagtaattaactggcttgaatccagttccagttagaggcctcctacatctgaatgggtcagaaggaaagtggtagtaaatgataatattggagggttgtaaaatttggcttttggaaattcacggggatttttgtgttctgcccctttgtttcattttcctcacacgcttaggtaggaaaaaaaatcattggctaagtcaatcaagggaacctgagagtaaagccaatatattaggtaaaaataggatccttaatttctggaaaactaagttctttctggctaattcattaggcctgggaagcagcaaagtcttacagaaatggcaaaatcttactaaagataacttatagtgtaacattccaaatgaataatgccctgaagtgcatttaaaaatgatggctcccaaattagtctcatctagggatgcctattaacatgcagaagcttctaaaaagatttagagatggcatggcctatctgggagcaagtttgagtcttaccagtttgacactgggtgctaagcaaagtggctcgtgtctatgttttgtcacatatattttgctctgagcagaatgaaaaatgttaatttggttactccaagcaaccccttgggcagcatcttgcaaagctaagtggattcttcctgtggctccatgatttccattgtgatgcagcttggcccccagagctataatgtggtgaggagggtgacagagcaagacgctatctttaaaaaaaaatggcccggggcagtggctcacagctgtaatctcaacacttggggaggccgaggcaggtggatcacatgaggtcaggagttcaaggccagcctgaccaacaaggaaaaaccccgtctctactaaaaacacaaaattagctgggcatggtggggcatgcctctaatcccagctactcaggaggctggggccggagaatcacttgaacctgggaggcagggggttgcagtaaaccgagatcgcaccattgcactccagcctgggcaacaagagggaaaatccatctcaaaaaagaaaagaataatagatttgcctgtaaggttttatgaaaaagtgggtgacatttggctttctctctttaaagaagattttcagaaaatattaaaaaataatgggaggaggagccaagatggccgaataggaacagctccggtctacagctcccagcatgagcgatgcagaagatgggtgatttctgcatttccatttgaggtactgggttcatctcactagggagtgccagacagtgggtgcaggacagtgggtgaagtgcactgtgcactagccaaagcagggcaaggcattgcctcactcgggaagtgcaaggggtcaggaagttagttccctttcctggtcaaggaaaggggtgacagatggcacctggaaaatcgggccactgccaccctaatactgagcttttctgacgggcttaggaaatggcacaccacgagattatatcccgctcctggctcagaaggtcctatgcccatggagtctcgatgattgctaacacagcagtctgagatcaaactgcaaggcagcagcgaggctgggggaggggcaccggccattgcccaggctctcttaggtaaacaaagcagcctggaagctcgaactgggtggagcccaccacagctcaaggaggcctgcctgcctctgcaggctccacctctgggggcaggacacagacaaacaaaaagacagcagtaacctctgcagacttaaatgtccctgtctgacagctttgaggagagcagtggttctcccagcacacagctggagatctgagaatgggcagactgcctcctcaagtgggtccctgacccctgacccccgagcagcctaactgggaggcgccccctagcaggggcagactgacacctcacacgaccaggtactcctctgagacaaaacttccagaggaacgatcagacagcagcattcgcggatcatgaaaatccacggttttgcagacaccactgctgatacccaggcaaacagggtcgggaatgggcctctagaaaactccaacagacctgaaactgagggtactgtctgttagaaggaaaactaaaaaacagaaaggacatccacaccaagaacccatgtgtacatcaccatcatcaaagaccaaaagtagataaaaccacaaagatggggaaaaaacagaacagaaaaactggaaactctaaaaagcagagcgcctctcctcctccaaaggaatgcagttcctcaccagcaacggaacaaagctggatggagaatgattttgacgagctgagagaaggcttcagatgatcaaattactctgagctatggcaggacattcaaaccaaaggcaaagttgaaaactttgaaaaaaatttagaagaatgtataactagaataaccaatagagagaatttcttaaaggagctgatggagctgaaaacgaaggctcgagaactacgtgaagaatgcagaagcctcaggagccgatgcgatcaactggaagaaagggtatcagcgatggaagatgaaatgaatgaaatgaaatgagaagggaagtttagagaaaaaagaataaaaagaaatgagcaaagcctccaagaaatatgggactatgtgaaaagaccaaatctacatctgattggtgtacctgaaagtgatagggagaatggaaccaagttggaaaacactgcaggacattatccaggagaacttccccaatctagcaaggcaggccaacattcagattcagaaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacggcggatctctcagcagaaaccctacaagccagaagagagtgggggccaatattcaacattcttaaagaaaagaattttcaacccagaatttcatatccagccaagctaagcttcataagcaaaggagaaataaaatactttacagacaagcaaatgctgagagattttgtcacgaccaggcctgccttacaagagctcctgaaggaagcactaaacatggaaaggatcaactggtaccagccgctgcaaaatcatgccaaaatgtaaacaccgtcgagactaggaagaaactgcattaactaacgagcaaaataaccagctaacatcataatgacaggatcaaattcacacataacaatattaactttaaatgtaaatggactaaatgctccaattaaaagacacagactggcaaattggataaagagtcaagaaccatcagtgtgctgtattcaggaaactcatctcacgtgcagagacacacataggttcaaaataaaaggatggaggaagatctaccaagcaaatggaaaacaaaaaaaggcaggggttgtaatcctagtctctgataaaacagactttaaaccaagaaagatcaaaagagacaaagaaggccattacataatggtaaagggatcaattcaacaagaagagctaactatcctaaatatatatgcacccaatacaggagcatgcagattcataaagcaagtcctgagtgacctacaaagagacttagactcccacacattaataatgggagactttaacaccccactgtcaacattagacagatcaacaagacaggaagtcaaaaagcaaacccaggaattgaactcagctctgcaccaagcggacctaacagacatctccagaactttccaccccaaatcaacagaatatacatgttttcagcaccacaccacacctattccaaaattgaccacatacttggaagtaaagttctcctcagcaaatgtaaaagaacagaaattataagaaactatctctcagatgacagtgcaatcaaactagaactcaggattaagaatctcactcaaaactgctcaactacatggaaactgaacaacctgctcctgaatgactactgggtacataaggaaatgaaggcagaaataaagatattctttgaaaccaatgagaacaaagacacaacataccagaatctctgggacgcattcaaagcactgtgtagagggaaatttatagcactaaatgcccacaagggaaaacaggaaagatccaaaattgacaccctaacatcacaattgaaagaactagaaaagcaagagcaaacacattcaaaagctagcagaaggcaagaaataactaaaatcagagcagaactgaaggaaatagagacacaaaatcccttcaaaaaattaatgaatccaggagctggttttttgaaaggatcagcaaaattgatagacctctagcaagactaataaagaaaaaaagagagaagaatcaaatagatgcaataaaaaatgataaaggggatatcaccaccaatcccagcaaaatactaaataccatcagagaataatacaaacacctctacgcaaataaactagaaaatctagaagaaatggataaattcctcgacacatacactctccgaagactaaaccaggaagttgaatctctgaatagaccaataacaggagccaaaattgtggcaataatcaatagcttaccaaccaaaaagagtccaggaccagatggattcacagccgaattctaccagaggcacaaggaggaactggtaccattccttctgaaactattccaatcaacagaaaaagagggaatcctccctaactcatttaatgaggccagcatcattctgacaccaaagccaggcagagacacaaccaaaaaagagaattttagaccaatatccttgatgaacattgatgcaaaaatcctcaataaaatactggcaaaccgaatccattaacacatcaaaaagcttatgcaacttgatcaagtgggcttcatccctgggatgtaaggctggttcaatatacacaaatcaataaatgtaatccagcatataaacagagccaaagacaaaaaccacatgattatctcaatagattcagaaaaggcctttgacaaaattcaacaacccttcatgctaaaaactctcaataaattaggtattgatgggacgcatttcaaaataataagagctatctatgacaaacccacagccaatatcattctgaatggacaaaaactggaagcattccctttgaaaactggcacaagacagggatggcctctctcaccacacctattcaacatagtgttggaagttctggccagggcaattaggcaggagaaggaaataaagggtattcaattaggaaaagaggaagtcaaattgtccctgtttgcagacgacatgattgtatatctagaaaacctcatcgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaaaaggataaaaacaaatggaagaacattccatgctcatgggtaggaagaatcaatatcttgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgatttcaaagtatactacaaggctacagtaaccaaaacagcatggtactggtaccaaaacagagatatagatcaatggaacagaacagagccctcagaaataatgccgcatatctacaactatctgatctttgacaaacctgagaaaaacaagaaatggggaaaggattccctatttaataaatggtgctgggaaaactggctagccatatgtaaaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaatgccaaaattgacaaatgggatcttattaaactaaagaacttctgcacagcaaaagaaaccaccatcagagtgaacaggcaacctacaaaacggcagaaaattttcgcaacctactcatctgacaaagggctaatatccagaatctacaatgaactcaaacaaatttacaagaaaaaaacaaacaatcccatcaaaaagtgggcgaaggacatgaacagacacttctcaaaagaagacatttatgcagccaaaaaacacatgaaaaaatgctcatcatcactggccatcagataaatgcaaatgaaaaccacaatgagataccatctcacaccagttagaatggcaatcattaaaaagtcagaaaacaacaggtgctggagaggacgtggagaaataggaacacttttacactgttggtgggactgtaaactagttcaatcattgtggaagtcagtgtggcgattcctcagggatctagaactggaaatgccatttgacccagccatcccattactgggtatatacccaatggactataaatcatgctgctataaagacacatgcacacgtaggtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacgtaaagccaaacactgcatattctcactcataggtgggaattgaacaatgagatcacatggacacaggaaggggaatatcacactctggggactgttgtggtgtggggggaggggggagggatagcattgggagatatacctaatgctagatgacgagttagtgggtgcagcacaccagcatggcagatgtatacatatgtaactaacctgcacaatgtgcacatgtactctaaaactaaaagtataataaaaaataaaaataaaaaaataataaaaattttttgtcatgatttttggtaaatgaatgacttacggtgacgtggaattctatttcataacatcaagtgtttaaacctttaatatatttaataggcttcccaaaatcaaatttcaacttcaaaattgtcttttctgacctctaattttgggatactacagagacccctgaagcacccaaaagagaggtaaacaggactatttaacatgttaagtcacatgggtagcactgtcaaaataaaaaataatgtggaaccttcctcaggttatatttagtgtgtgtcatcaatccattctaaaatagtgtaggatttctaaaattcttgtattttttttttttctgagatggagtcttgctctgtcacccaggctggagtacagtggcgcaatctcggctcactgcaacttccgcctcccgggttcatgccattctcctgcctcagcctcccgagtagctgggactacaggcacccaccaccatgccaggctaatttttgtatttttagtaaagatggatttcaccgtgttagccaggatggtcacgatctcctgacctcatgatccttccacctcggcctcccaaagtgctgggattacaggcatgagccaccacatccaccctaattatggttattaagttattgtagaccacagaaataaccaaatttccttgtcaattgtctttaactataactaaagtcatttcacagttaattgcttaatagtgatgcagtttctaaaaacttcacaagcatgcaaaattctagagtatggtgtctcttagaagattcatgaaagaatgaaaatgaccctgaaaaacactcgtgaacacagatttctaataactttaatatcatgggtaaaaattccccataagttccccgataccccaagaattggactggctaagaattctcaacagttaggctgggtgcagcggctcatgtcggcaatcccagcactttaggaggccaaggccggtggatcacttgaggtcaggagtttgagaccagcctggccaaaggtgaaaccccacctctactaaaaatacaaaaattagctgggtgtggtggtatgtgcctgtaatcccagctactcgggaggctgtggcaagagaattgcttgagcccaggaggcagaggttgcagtgagccaagattgtgccactgcactccaacctaggtaacagagtgagactctgtctcaaaaaaaaaaatatcaaaaatttaataaaaagaccaactggtttgtaaaactgctaacccaagtaaaacaaaaattgtataccaaggaaatattatgccacattttcatgctaaatcaccaatattgaaattgtttagatatataatttaaataaactccatggtctaaatcaaattacctataactactcatcagttaccagtgccatgcacctaatttggagaaacagctggtattcaagaggatgtaagtctgatgttaattaagcacagacctataaagaaccaggatggccaccttatccttcttaagtcctaaaaacttttgttattaaaagttctgcattccataactcatcacagaaagagaaaacgatccaaattaaatatattggtgtggtgatttctaaactgctaaaatagtttataaccaatgtttggtttgtgaaacctatattcctaggaaaacaatcaaaacttcaggtacatttggttatctgatgggccatttaaacattttataaagggatttcattcagttgtcattttcagtgcatgttttctgattgtataaaagctcttccatgcgagagagttgatgttaaaacagtagattattaccctgaagtgtattttcaccaggtaaagaaagccttttatggttcactgaggacagtcaaacccttcaaaatctagaatctgatgactggatcttctgagaacatcagagaaggactgccctcgccatccacatgacaacaaaactttaaaaccttaaactttgggttcatagtctcacaactcagaagggtccctccacactcagaaccatatgcctattggaacccttaaggtaaagctaacacggacagttccccccagaagaagatggcatccttaatgtgaacagcttttcccaagatcacagatcaagacttctctactatcatgagactcttatcttaagtatctgtgcagctgctaacacttacagcatgtggagaaaacatggggtattataaagatttggttgtagggaattaacaaaaaaaaaccacttagttaagcaagtaaaccctttatctaattcattctttaatctatttgatttttggtggtttgatttatggggaccctgagtaaggagcatataccacatcttggtgttatcccaatagtcataagagtctccctggtgtactgtacttactcaaatgtttcaagagtttgcatgcagccatctctaaaatgtcaaatggtatctcttcaactggaatgacaagagattaaaagaaatgtgcaaccataaggccaccataacctatgagtgacatgctaaactggaaacccaaaacaatgggagtgacatgctaaaccagaaacccaaaacaatgggagtgacttgctaaaactggaacccaaaacaatgagagtgacgtgctaaaaccggaaacgaaaacaatgggagtgatgtgcttaaactggaacccaaaacaatgggagtgacctgcaaaaccagaaacccaaacaatgggagtgaggtgctaaaaccagaaccctaaacaacgggagtgatgtgcttaaaccagaaccgaaaacaatgggagtgacctgctaaaccagaaatccaaaacaatgggagtgatgtgctaaaaccggaacccaaaacaatgggagtgatgtgcttaaaccggaacccaaaacaatggtagtgacctgctaaagcagaaacccaaaacaatgggagtgtcctgctaaaccagaaacccaaaacaatgggagtgacgtgtaaaaccagaaacccaaaacaatgggagcgtcctgctaaaccagaaacccaaaacaatgagagtgacatgataaaccagaaacccaaaacaatgggagtgacgtgctaaaacctggaaacccaaaacaatgggagtgaggtgctaaaaccagatacacaaaacaatgggagtgacatgctaaaaccagatacccaaaacaatgggagtgatgtgctaaaacctgaacccaaaacaatgggaatgacgtgctaaaccggaacccaaaacaatgggagtgacgtgctaaaaccggaacccaaaacaatgggagtgacatgctaaaaccagaaacccaaaacaatgggagggtcctgctaaaccagaaacccaaaacaatgggagtgaagtgctaaaaccagaaacccaaaacaatgggagtgtcctgctacaccagaaacccaaaacgatgggagtgacgtgataaaaccagacacccaaaacaatgggagtgacgtgctaaaccagaaacccaaaacaatgggagtgacgtgctaaaacctggaaacccaaaacaatgggagtgaggtgctaaaaccagaacccaaaacaatgtgagtgacgtgctaaaccagaacccaaaacaatgggagtgacgtgctaaaacaggaacccaaaacaatgagagtgacgtgctaaaccagaaacccaaaacaatgggaatgacgtgctaaaaccggaacccaaaacaatgggagtgatgtgctaaaccagaaacccaaaacaatgggaatgacatgctaaaactggaacccaaaacaatggtaactaagagtgatgctaaggccctacattttggtcacactctcaactaagtgagaacttgactgaaaaggaggattttttttttctaagacagagttttggtctgtcccccagagtggagtgcagtggcatgatcttggctcactgcaagctctgcctcccaggttcaggccattctcctgcctcagcctcctgagtagctgggaatacaggcacccgccaccacacttggctaattttttgtatttttagtagagatggggtgtcaccatattagcaaggatggtctcaatctcctgacctcgtgatctgcccacctcaggctcccaaagtgctgggattacaggtgtgagccaccacacccagcaaaaaggaggaatttttaaagcaaaattatgggaggccattgttttgaactaagctcatgcaataggtcccaacagaccaaaccaaaccaaaccaaaatggagtcactcatgctaaatgtaacataatgaaactaagactttagggaaacacataaatcctagaacaaaccaggttttgtttttctcctgtaaacaggatgttccagcataagaagataccttctactcaagtccttgttccaccttttcaaatctcactggtctatttcccagtgggtttctaaaccaagtaagtacatttgcaatggtaatagtgacaccagtgactgaagtttcggccaatctctcaaaattgagaaaataaccaaagggaaggcattgttaaagtgaactaagtatggcctgagaaggactccataattctatatatgagtccttgtgggtgaactgcaacctaccttaataggtatacaagaatgaaaaactaacttaagagtatgcacctggaacaacagctacatcttggccaatcccaatggccaaacttcaaccactcaggcactgccaaatgttcaaaatgtgttcaaacaaggcaaacgctgagttgtttctgtacctcacttccgatttcggtatgccacttcccttttgtctataaatcttcttccaccacatgactgcactggagtctctgtgaatctgctgtgattctggggactgtccgattcatgaatcgctttattgctaaattaaactcctttaaagtttttcttttaacagaactaacacagaagaatttccagatcatgaacagacgttttgtaatacccaacgttgtattaacatgaatagactcttccttagacagctaaccttgtttttaatatgaatagactctcccttagctgagaaaaccagacaaactccatttggctccttcattaacaagacatcaaggactccttacccaccccctttcctcaaggactttaacttgtgcaagctgattttcaacatatcaaagcgtgcaattaactgataaagtgctgagacaagagatgtccccagttcccagcaatttactcagagatagtatcataaagcccccacatttgtccggcagataatgcccagagccccctcacctatcactttgtggtgaatttaaagaccctacaccaggaacagtttgttttcctgtaaccatctgtttttctaagttttttgtctgtttttttcttctgtaaagttgctgcagctagaatcccccctcccctctctaaaccaaagtataaaagaaaatctagtcccttcttcagggccgagagaatttcgtgcgttagccatgtctcagtcgctggctagtaaaggactcctgaattcgtctcaatgcgtggcatttctctctaactcactcgggtacgacagtttcaactatggtagaagactcgagtaaggcaaatacagtccccctaaatttgactattattcagattaatggtgagtttagaagaaataaggctacacagagtgggctaaagtgcaaataaacactggaaatatttcccagaaaatatgactttgaacaggctgctgcacaccctgcatgtagagataaactaagaaaaacgtgtggagagttatttaaggacctatggttaactcagtcctcaagatgttccaggtttcatccatgaatcaaggaggacctcccaaaggctgtttgggaccacactctttgagtaaggagcatacattacgatggaagctgtgttttagcagcagatgaccatttccgctgcacaacacgccgtgctttagcggaagatgaccgtttccactgcacaacactacaagtgtttactgccaggccggtgtgaaatatgttccagcacataatctatgtcaccaatgaaggtggtggttcagacttggtgcacgcaagctttcctgtcccacaagaacacagcatgctctcttctcgggttccattccaatcacataacaaacatgactgccttttttgtctcggcatcagaaagatcagaggaaaatttgcactcaacttagacaactctaagctcttataacctgcctatatctacaggtcagctttatcttatttatgtatatttccttcaacctgagttttacttatttctacttttcctttttaattcacagacacccataaactcagaaaatacagtgtaaaacaaagtgaagaacaaataaacaactcaccagagatttattcatttcttgttgctcttggaaacacccagaggacactggaaacatagctgggatagaaggcaaatgacgtggattaaggagagaactggtgtggtgtggtcccagattcttctgcccaacactctagacacattacctgggaaagccctcctccctcctgaaaaagaaaaacttccccaggggagaagagtccttcacacctcattaggggcagcaaagactcaagttaagataagatacatctacaagtacattaattggtagacattagatgcacaatttatttttgaataaaaatatatattacctactaatttagtaacaatattatctaaagatataatctaataatttaatacaaagaaacattataagttcactaaaataaatgttatagaaatatactgggctgtattaactattttcctattaatatgtagattccacaaataacttcatatgagtgttcccatgacagtacatcttgcttttctatacctgaacatcatggaaagtgcatcttgcaaaccagcaattttggcctacaattacgttttttaaaatgtacataatatgtatttcctgcagtacaccattctactcatgtttcccaataacacctttccttctatccaagccctcatattatgctctgacaataaattgggcttttccatctgacttgtccagtgaatggaaaatggaaaatgtgatgcaaatatccattggttctttcctttttgggggaaattgtgaagaggtctggagctaccctgttggagacacagggcctagccaagagtcaccacaaaccaccagattgtgaagtaaactatcttaaaccaaccaggctcagtcaaggcaccaggtgactgaggcctttttgtgatccaggcaacacaaatatattaactacccagctgaacccaccacaccaaagtgcagatccacagaacttcgaacaaataaaatggtggttgttttttataagccagtaaggtttaattagttccttaaacagcaagtattaactgttacacctaagtgaacagaattcacttctgtgtttttaacaaaattacgtagggggagaaaatgttaaattacaaatcaaatacaatcaatagaacttcgcaatctaatgttaaatttggggatggactaggtttaatatatctcagacgctggaaaaaacgagctaaggttgaaggaatgggactgtgtttggagagtattttaatcctctcaagtatgacaggtcactgctgtaccccagaccacactttcaggccccttcaaataaggaatatttcctaagtccttgcctgttcttcttagctgaattcacctcaaccttctgaaagttcgtccaaaccttctactatcacctagtctttgcaaatcttgtgcattctagggagtagaattaatatttcctgagcaaggaaaactgggatcttcacctgtgaccttttttcctcctctgaagcaccagtgagaggttagaccagatggctgttctttcaagtgtgcttcttattcatagggaaccctccctttcaaactttgtaacacacagttaagactgaagtatccttaaggctgacgaccatcatccattaagccatctccctcgcggaatcagtgagttcttccctggaaactaggtctcgtataaacttctgtaaatgcgacccaggaggactaggcaggtcacacagtgaagaagggaaccagaaacttcacttgctaaagagacaccaggaaacccaactaatacaaacgccaagtttaagactagaggcgcacgcgtttcacactactcctctgggaatggggaacgtctcccgagaactgtgtgttaccactgggacagatgggcaaactgagcgtcatgcaggttggtaaccgggtccctcagcggcaggacaggagcgcggcctgcagactccgggcccagggccaccggcctctcctacctgctcctgcgcctctagaacccgtttcactgccgggaccccacgcctgtcctcccagcccccgccagggtccactgcccgcacctgcacttcaggccctgcccgcccgcaatgtgcccacgcgtctgctcccacaactagggaacactggtccggccccccgggatcccctgaggcccacgggttcctcttcgcccttgcaccgacccgcagggacatagaaccaagccccaagccggcccggctacaggaccgcctctgggtgccgcacttccggaggaaaatggcggagtgggccgggcggcgcaagcgcagagagaaaagctggttcccaaggtccttgatggtaacatcattggaaggtgacactacaattcccatgagactttgcggtaccccgttaggaacccaagccggacattctgttttgcccagcagttgagtccagttacccagagacccggacttaatgtatcaggactggtccctacccaggtgacacagatgtggcattctggttctttattaaatcctggtttcacagcctgggacattgtgaaaataatggagaaatttcaatagaggccaattggtctatgctatgaataagttgtttttttttttttttttttttttgagaaggagtctcactctgtcgcccaggctggagtgcaatggtgcgatctcggctcactgcaacctccgcttcccgggttcaagcgattctcctgcctcagcctcctaagtacctgggattacaggcgcgtgccaccacactcgcctaatttttgtatttttagtagagacgggttttcaccatgttagtcaggctggtctccaactcctgacctcgttatccgccctcctcggcctcccaaggtgctgggattacaagcgtgagccactgcgcccagccctcaagtctattttttatagatgcattcgaaagcatgaaaaaaataatgtctctattttactttaaaaattttaaaacacaactaatgaatatggtaattctcttccaatccgttatcttttctctcactaaactaatttgtgagccttcaatttacactgttagaaaatatgctctagtgcacatactaggataaaataacagggtcataagacaggtgcactccataatctttgtgacaacttacacttccagtgtctgataaatatttgcccgtagactcccaggtttcatccatccatccatcaatcaaatctacctatctttatttatttattgtgagaaagacctgaaatttgcctttccttccctgatgtctgccacaaactaggcaaggagttctgcctaggggtttctcagagctccggctaccaccgaggttcctaacagggaaatgcaggcttgaatgctcagggttgatgtgggagtgcgtgtgaaacggggatggggtgaaagggcagtgacgtttgtaggtgggcagatgggggtgtgatgggctttcaggtaagaggcacgcaggaacctgggagaggcagcgaaagcacctcacgcctcagatcaccagaagacgctcccaccagtgccatgacagtttgccaatgccatgtcatcacgagaattccccaccccttgccatggaaacagatggaagttactgcccatttctagctatttctgaataacccgccccttaattagcatgccattaaaagtgaattataaaaatgactacaagccacccctaggctgctgctctgggagcacaacccacggagggctccctgccctgccggagtggacgctgtgctgtaacaccgccaatgcctccgtagagctgctttcttccaccacaggcttgcttttggatttcttcctaaacgacgccaagaacctgcccttcctcagtgtgactcttgcctaaaacctatccctggtattctcttttcctaagcatgccctgacttgttctttcatctcctctgatcttgcaattggtcctcagtgactctattctgcagatccagaaaactcaaccttaatcttcccagagccctgttgtctccaatattggaatctctagccttgttttctcagacgcctagattacaggcctctctcttgaacacctattggtatggtatctggggatcctttaaatacatgatgattggcaggggttaaatagcggaaatcagtgcctgacaattcgccttccaggatatggactgtcattccctctcttggtgggcctcagtctcttatccataaaagtagagattgtaatactcatttgaaatgcagatacctcaacccgaacccacctaatataatgtaaaagccaagaatgcaacccctttcctcaccccgtgaaggtaaagccctcagagccaaggagagaaggctcagggatggtatctgggtgtttccaacgctaaccatgtattgtagtttttagtgttcaagtttaagcttccccagctttaattctattgtaacaagatttatttttttaattccatttttggattcttgatttattggtaaagaaatacagttatttttgtataccaatcttatatagtgttacattcttaagtttgttcatgagtcctaatactttttagtaaatttcttacgattttctaaatgcaagatcatgtcatctgtacataaagataactgtacttcttcctttccaatctagatgttgtttatttatttacattgccaacttgtcccagctaccactgttatcaagtaaaagggtctcactgcccaaagcacaagaagccggtaccatgacactgagttttcgagaaaagaaaaagtttaaagtcaaaccaaaacctagggtacaggccgggcgcactcggtgaaaccccgtctctactaaaaatacaaaaaacaaaaattagccgggtgtgaaggcaggcgcctgtagtcccagctactcgggaggctgaggcgggagaatggcgtgaacctgggaggcggagcttgcagtcagccgagatcgcgtcactgcactccagcctgggcaacagagcgagactccgtctcaaaaaaaaaaaaaaaaaaaaaaaaaaaaaaacctatgggatacagtaaaaacagtactacagtactaagaggtaagtttatagataaaagcacctacatcaaaaaaagtagaaaagcttcaaataaacaacctaataatgcatcttaaataattagaaaagcaagagcaagccaaaaccaaaattagtagaaggaaacatagcaaagatcggagcagaaataaatgaaattgaaatttaaaaatataaaatatcaatgaaatgaaaagttaatatttttaaaagaccaacaaaatcaacaaacacttaaccagactaagaaaaaagagagaagattcaaatacataaaaccagagattaaaaaggagacactataactgatactgtggaaattcaaagaatcattagaaactattatgaccaactatattccaataaattgaaaaacctggaagaaatggctgggcaccgtggctcatgcctgtaatcccaacactttgggaagccaaggcaggtgatcacctgaggtcagtagttcaagaccagcctggtcaacatggtgaaaccccatctctactaaaaatacaaaaattagccaggcatggtggcatgcacctgtacttccagctactctagaggctgaggcaggaaaatcacttgaacctgggaggcagaggttgcagtgagctgagattgtaccacgctgcagtctgggtgacagagcaagattccatctcaaaaaaaaaaaaaaaacctagaagaaatggataaatgaaattgaagccgtaataaaacatctcctagcaaagaaaagcctggattcaatggcttcactggcttcactgattaattttaccaaacattgaaggcagaattactatcaatcctactcaaactattccaaaaaaacagagaaggctgtagtatttccaaactcatcctatgaaaaagaccattcatcatgtctaagtgggatttatcccaaggatgccaacatggttcaatgtatgcaaatcaatcaatgtgacacatcatatcaacagaatgaaggacaaaaaccatatgataatttcaattgatgctgaaaaggatttaataaaattcaacatccctgtgataaaaagaaaccctcaaaaaaaaactagatatagaaggaacataccacaacacaatgaaaaccatatgcaacagacccacagccagtatcatcctggacagggaaaagctgaaagcctttcttctaagatctggaacaagacaagaatgtccacttccaacactgttactcaacatagtactggaagtcctagctagagcaattcagacaagagaaaaacaataaaagggatccaaattggaaagaagtaaaattattactgtttcttgtttgcagatgattagctcttatatttggaaaaacctaaggactccaccaaaaaactattagaactgatcaacaaattcagagtcacagcatacaaaatcaaactacaaaagtcagtagcatttctaaatgacaaaaatgaacaatctaaagaagaaaatcaagaatgtaatcccatttacaatagctacaaataaaataaaataactgggaataaacataacagaagaagtgaaagatctctacaatgaaaactataaaacatagatgcaaaaaaattaaagaggacaccaaaaaaaaaatggaaagatagtccatgttcatttattggaagagtaaatattgttaaaatacccatacttcacaaagcaatctacagattcaatgcaatccctattgaaatactaataactttcttcacagaaatagaaaaaaaatcctaaaatttacatgaaaccataaaagacccagaataccaaaagccatcctgagcaaaaagaacaaaactggaagaatcacatcacctgactttaaattatagtacagagcaattataaacaaaacagcatggtactggcataaaacagacacatagaccaatggaacagaatagagaacccagaaataaatccatacatttacaattaactcattttcaatgaaggtgccaagaatatacatgggggagagtacagtctcttcaacaaattgtgctgggaaaactagatattcattggcagattttttttttttttgagatggagtctagctctgttgctcaggctggagtgcagtggcgcgatctgggctcactgcaagctccacctcccgggttcacaccattctcctcctcagcctcccaagtagctgggagtacaggtgcccaccaccacgcctggctaattttttttttgtacttttagtagtgacggagtttcaccgtgttagccaggatggtctcgatctcctgcccccatgatccgcccaccttggcctcccaaagtcattggcagaatagttaaactagaaccctctcttgcactatatacaaaaatcaaatccaaatgggttaaagacttaaatcaaagacacgaaactactgaaagaaaacattagggaaactctccaggaaattggtcttggcacagatttcttgagtaatactccaaaagctcaggcaaccaaagcaaaaatgaacaagtggtatcacatcaagttcaaaagtttctgcacagtaaagaaaacaatggacaaagtgaaaagacaatccacagaatggaagaaaatatttgcaaactatataactgacaagggattaataaccagaatatataaggagctcaaacaactctacaagaaaaaaactaacaatccaattatttaaataggcaaaagatctgaacagacagttctcaaaagaaggcacacaggtcaggcgcagtggctgacacatgtaattccagaactttggggagccaagacgggtgggccacttgagcccaggagttcaagaccaacctgaacaacatagcaaataattttaaaaactacctgggcatggtgatgcatgactgtggtcccagctactcaggaggctgaggtgggaggattgcttgaaccctggcagtcaacactacattaagccatgatcataccactgcactccagcctgggtgacagagtgagaccctgtctcaaaaaatgagcaaaaacaaaaaagaacatatataaatgtcaaataggtatatgaaaagatgctcaatatcattgatcatgacagaaattgaaatcaaaactacaaaaatatatcatcttaccccattaaaatggcttttatgcaaaagacaggcaataacaaatgctttcaagaatttggggaaaagggaacactcttactctgttggtgggaatgtaaattaatatattcactatggagaacaatatggaggtccctcaaaaaattaaaaatagaactatcatatgatccagcaatcccactgctgggtatatacccaagagagggaaaattagtatatcaaagagatatctgcattcccatatttatttcagcactattcataatagccaagatttggaagcaacctaagtgtgcatcaacagatgaagggataaagaaaatgtagtacatatacacaatggagtactcttcggccatgaaaaagaataagattctgtcatttgcaacaacatggatggaactagaggacaattatgttaagtacaatgagccaggcacagaaagacagacttcgcatgttctcactcatttgtgggagctaaaaattaaaacaattgaactcatcaagatagagagtagactgagagtttccagaggctgggaagagtagcggtgttatgggatctttggggtgttacttttctggacagaaacctctatgactggtggcacctttgcctgagttttgctgggccccgcacactcagcctggcaggctgtgctctgctcatgctaccacgttggatcccatgcctgccaagggagactgcatggagtggcaaggggtgtgtgagtgagcatggggtctggccactgtgcagtcagatttgctggctgctgaagtggagcaggtagctccaggtgccaacacgggcgccagctctccacaaggctgtggctggaccacgggcacctcaagaagcttccacagctggcacactgggaacacagtggcacccagaagcttggagatatcaggaaccaaagaccccaaagaaggaatcacagctctggctcagggagctcccaggtctgggctccccaaagggccatagctcttctttccttctctttgcccacaatgtggcgagcaaggggcatgtctcagccctgtttgtgttacagctctttcagcctcttccctaggatttgtcataattaattcccatatcgtcttatttttttacacgtgtttcaacttcagaagatgtatggatctaaacacaacatgaagtgttagctagctgccatatgagtttctccctgtttcaccactatgtagcctaaagttattccgtcatccatgactatcctggctaaagagtctgaagatctttatttggtagctatggcttcagctagttcatttgctaagttacctagagtggttgacagatttctaattatacgttcatgagaggttactccccaccattgcaagagatttctgccaaacataggccaaaattcatctccttggtttgcaggtatggtttgtctaatcctggaaaataatttcgatgaactacttcagcgttcagaaacattggagttataaataggaagaggaagagccacataacctaatagacaattacctctcatatgccagcggtcaacacattcataagcccatgtgtgcttgatccagggaccacacagggtccctgacggattctgaaatttaaggctttggtttactggtaacagagacaggttaaagtacatgtcttcagtcttgagtagagtgcaatcagtctgatttcttttttttttttaatgagacaaacatcaggtaaagaccttgacaagaaggaagataaatcccgagattctataatcataataatcgaattgtaattgctagtttaagtagtcctacaaaaatacatctcattactgacaggataaaacaagttttttaaaaatatattttatctgggttcactagggaacacttggagccagaaaataattcaggattcagcccaaattataggcaaataataaaaactcggaaaagaatgatcagggctggaatctaatagcatatgtcacagttttcatttgaaacatgaattttgtctctctagtccatcattttatcaaagacaaaccatagtaggacaaatttctgtgcaaaataagttttagtcttatcatacctggtctgattatttgcataaagtgcagcaagaatatttattgaccatataggcttcttaaaattggctttgttggaactttctaataaggaatcttagacttttaaaagccttgaggctagccaagtcaaagatttgcatcatactgtgtctgtaatacttttttttaacctacgtttttattatactttaagttgtggggtacacgtgcagaatgctgaggtttgttacataggtatacatgtgctgtggtggtttgctgcacccatcaacccatcacctatattaggtatttgtcctaatgctatccctccccccgcccccaacccccaacatgccccagtgtgtgatgttcccctccctgtgtgcttgtgttctcgttgttcaactcccacttatgagtgagaacatgtggtgttttgttttctattcttgtgttagtttgctgagaatgaaggtttccagcttcatccatgtccctacaaaggacatgaactcatccttttttatggctgcatagtattccatggtgtatatgtgccacattttctttatccagtctataattgatgggcatttgggttggttccaagtttttgttattgtgaacagtcctgcaataaacatacgtgtgcatgtgtctttatggtagaatgatttataatcctttgggtatatacccagtaatgggattgctgggccaaatggcatttctagttctagatccttgaggaatagccacactgtcttccacaatggttgaactaatttacactcccaccaacagtgtaaaagccttcctatttctccacatcctctccagtatcttttgtttcctgactttttaatgattgccattctaactggcatgagatggcatctcattgtggttttgatttgcatttctctaatgactagtgatgatgagctttttttcatatgtttcttggttgcataattgtcctcttttaagaagtgtctgttcacatcctttgcccactttttgatgggattgttctttcttataaatttgtttaagttctttgtagattctggatattaggtctttgtcagatggatagattgcaaaaattttctcccatttcgtaggttgccctttcactctcatagtttcttttgctgtccagaaactctttagtttaattaggtcccatttgtcaattttggtttttgttgccattgtttttggtgttttagtcatgaagtctttgcccatgcctatgtcctgaatggtattgcctaggttttcctctagggtttttacggctttaggtattaggtttaagtctttaattcatcttgagttaatttttatataaggtgtaaggaagggatccagtttcagctttctgcctaaggctagccagttttcccaacatcatttattaaatagggaatcctttcctcagtgcttgtttttctcaggtttgtcaaagatcagatggttgtagatatgtggtgttatttctgagggttcggttctgttcctttgatctatatatctgttttggtaccagtaccatgctcttttgtttatcatagccttgtagtatagtttgaagtcaggtagcatgatgcttgaagctttgttctttttgcttaggattgtcttggctattcgggctcttttttgattccatatggaatttaaaatatatttttccaattctgtggagaaagtcaatagagtttaatggggatagcagtgaatctataaattactttgggtagtatggccattttcacgatattgattcttcctattgatgagcatggaatgtttttccatttgtttgtgtcctctcttgtttccttgaggagtggtttatagttctccttgaagaggtccttcacatccttgtaagttgtattcctaggtatttcattcttgttgtagcaatggagaatgggagttcactcatagtttggctctctgtttgtctgttattggtgtataagaaagcttgtgatttttgcacattaattttgtatcctgaaactttgctgaagttgcttatcagcttaaggagattttgggctgagacgatggggttttctaaatatataatcatgttatctgcaaacagagacaatttgacttcttcttttcctaattgaacaccctgtatttctttctcttgcctgattaccctggccagaacttccaacactatgtggaataggagtagtgagagagggcatccttgtcttgtgctgattttcaaagggaatgcttccagtttttgcacattcagtatgttattggctgtgggtttgccataaatagcacttaatattttgagatacgttccatcaataccagtttattgagaatttttagcatgaagggctgttgaattttgtcaaaggccttttctgcatctattgagataatcatgtagtttttgtcattgattccgtttatgtgagggattacatttattgatttgcatgttgaaccagccttgcatcccagggatgaagccaacttggtcatggtggacaagctttttgatgtgctgctggattcagttttccagtattttattcaggatttctgcattgatgttcatcagggatattggcctaaaatttcctttttttgttgtgttggcctcataaaatgagttagggaggattctctttttctattgtttggaatagtttcagaaggaatggtaccagctcctctttgtacctctggtagaatttggctgtgaatccgtctggtcctggactttttttggttcgtaggctattgattaatgcctcaatttcagaacttgttattggtctattcaggaatttgacttcttcctggtttagtctttgtagtattctctgatgataatttgtatttctgtgggatcagtggtgatatccccttaatcattttttattgcatctatttgattcttctgtcttttcttctttattagtctggctagtggtctgttttgttgatcttttcgaaaaaccagctcctggattcattgatgttttgaagggtttttcatgtctctatctcattcaattctgctctgatcttatttatgtcttgtcatctcctagcttttgaatttgtttgttctttcttctctagttcttttaattttgatgttaaggtgtcaattttagatctttcctgctttctcttgtgggcatttagtgctataaatttccctctacacactgctttaaatgtgtcccagagattctggtacgttgtgtctttgttctcattggttttgaagaacatctttatttctgccttcatttcgttatttacccagtagtcattcaggagcaggttgcccagtttccatgtagttgtgaggttttgagtgagtttcttaatcctgaatactaatttgaatgcattgtggtctgagagactgtttgttatgatttccattcttttgcatttcctgaggagtgttttacttccaattatgtggtcaattttagaataagtacaatgcggtgctgagaagaaggtaaattctgttgatttggggtggagagttctgtagatatcttttaggtccacttggtccagagctgagttcaagtcctggatattcttgttaattttctgtctcatctatctaatattgacagtggagtgttaaagtctcccactattattgtgtgggagcctaagtctctttgtaggtctttaagaacttgctttatgaatctgagtgctcctgtattgggtgcatatatgtctaggatagttagctcttcttgttgcattgatccctttaccattatgtaatgcccttctttgtctctttttatctttgttggcttaagatctgttttatcagaaactaggattgcaacccctgccttttgttgctttccacttgcttggtaaatgtttcttcatccctttattttgagcctatgtgtatgagatgggtctcctgaatacaacacattgatgggtcttgactctttatccaatttgccagactgtgtctttcaactggggacatttagctcatttacatttaaggttaatattgttatgtgtgaatttgatcctgtcattatgatactagctggttattttgctcattagttgatgcagttttttcattgtgtcaatggtctttataatttggtatgtttttgcagtggctgttaccagttgttcctttccgtgtttagtgcttccttcaggaactcttgtaaggcagtcctggtggtgacaatatctctcagcatttgcttgtaaaggattttatttctccttcaattatgaagcttagtttggctggatatgaaattctggcttgaaaattcttttctttaggaatgtcgtatattggcccccactctcttctggcttgtaggctatctgccaagagatccactgttagtctgatgggcttccctttgttggtaactcaacctttctctctggctgcccttaatattttttccttcatttcaaccttgatgaatctgatgattttgtgtcttggggttgctcttcttgaggagtatcttagtggtgttctctgtatttcctgaatttgaatgttggcctgtcttgctaggttagggaagttctcctgaataatatccttaagagttttttccaacttggttccattctttctgtcactttcaggtacaccaatcaaacgtagattcagacttttaacatagtcctctatttcttggaggctttgttcatttcttttcactcttttttctctaatcttgtcttcttgctttatttcattgagttgatcttcaatctctgatatcctttctcctgcttgattgattcagctattgatacttgtgtatgcttcatgaagttcttgtgctgggtttttcagctccatcaggtcatttatattcttctctaaactggttattctagttaacaattcgtctaacctttatttttcaggctcttagcttccttgcattgggttagaacatgctcctttagctcggaggagtttgttattacccgccttctgaagcctacttctgtcaattcatcaaactcactgtctgtccagttttgttcccttgctggcggggagttgtgatcttctggaggagaagaggcattctgacttttggagttttcagcatttttgcactggtttctccccatctttgtggatttatttacctttggtctttgatgttggtgatgtcgatactattcctttctgtttgttagttttccttctaacagtcaggtccctctgctgcaggtttgctcgagtttgctggaggtccactccagaccctgttttcctgggtatcaccagtggaggctcagttggaaatgcatgaaccacctgacttctgtgttgatctcactgggtgctgcaggccggagctgttcctattcagacatcttgccagctctcctgtaatactttaatgaataggtgtagtcctctcttctcaaggtccccaaatatcttgaggttcctggcccatcagaaagtgacattctttatttcttaccacaagaatagcaactttgtaaaggacctttgtatacaggacatcaagccagtcattctaaggggctttgtattggtgctataaagtcaacctcaattccttaaagtggtctggttgtatctgccattcgagttaaagccttgataaaacaaacagtgtctccaattgaatcttgttaccaaaaacagattcttattgaaattatgcaaataattatattgccataatttaagaatgctcacgaatggcttctgaattctggagaaatcagctagagagacagataaatggctcaaatttttgttcacaatgtagtttatctaatgtattgtaagttaaaaatagctgaaaagaaaaaaaattattgactttggaaaacaaaacataaagaggatcaacaatgtttctaatgggagggccatggataaaatcttttccttcttttataagttcactcccatgtaactaaatcttgttctgcttgatttcaaatagcaattctcattcagttttttgtgttttgcttgatttcaattagaaattctcattcagctttttagagtcctggaagattttcctagtccaatggtttgatccccaaagttatctgaaaccatatttaagagaacttgtcagaatcctttccattaaaagtaatttagatgatagctgattgtaaaggcttttttttttgagacacggtctggctctatcactcaggatggagtgcagtggcatgatcttggttcactgcaatctctccctcccaaactcaagccatcctcctacctcaccctccgaagtagctgggaccataggcatgcaccatcatgcctggctaatttttgtatttttgtagagatgggattttgccatattgcctaggctgctttcaaacttcttagtttaagcaattcacccacctcagccttgcaaagtgctgggatatttacacgcatgagcctccatgccctgcaccatgcccagcaccgtgccctgcatggcctccagcactgtgcccggcctgtaaagggttttagagaagaactttaatcaatcaccgtggatgacaaaaacttagaatagccgttggttaaaatccagtggaagttctcaaatctcgagaaaatttagttatttgtattatatgtagcattttaagataacagccagaatcatgactgatggcaacacatcagatccatcagacttccacaaattttatataatctttagaatatttatattaataatatatctatacacatacaactttagaaaatatttaacatcatcaaaattatgactgaaaccctattagatttttataatttatataacttttaaaatatttatattaataacatacctataaatgtaaccaaaagaagatttaagctgggcacagtggctcatgcctgtaatcccaacactttgggaggccaagttggacagatcatcagaggtcaggagttcgacacctgcctggccaacatggagaaatcttgtctctactaaaaatacaaaattagccgggtatggtggcacttgtctgtagtcccagctacttgggaggttgaggcagaagaattgcttgaaccttggggcagaatttgcagtgaaactagatcatgctacagcactccagcctgggtgacaaagcaaaattctgtctcagagaaaaaaaaaaagaagatttagtgttacttatcttttggcaatgcttcccatacaatgttatcaactaagttttagcaaagatgtcaaaaaattgaaaacatttgaccaaaacggaatggcagtttattgttttttattttattatttttttgagacagggtctcaccctgttgcccaggctggagtgcagtggtgaaatcatggctcactgcagcctcaacctcccaggctcaggtgatcctccaccttagtctcccaagtagccaggactatgagcacttgctaccacacctagctagcttttgtatttttagtagatatggggttttgccattttgcccaggctggacttgaactcctgggctcaagtgatccacccaccttggcctcccaaagggctggaattacagacaagagccgctgcacacagccacatgtcatttttaaataacattcatttaattaacatgacaaccaaaagacatcaaaagcaacatagaaggttacatggatgtgaaaactgaaaaccctcagttttcccaagtaattaaaaaaacaataaaggcaacacatggattatcttgataaaacctaaaatctttattacaggccagtcatttaaagggtaaaagctcctgtggcataattgtgtcttcttatgggaagctaatttaaatcacttggaagtcaaaccgatgacacggagacttgaatttaattagacatagaaagagtgtgtccacggtcatgagtgagcataatattacagaggaatgtaaacaggaaaaccagagcatagagcagtggggatccatagctcacaatgatagcatggaagtttcctgctgtatcctggttacatgaagtaattaagacatatttaaaggccaagagtacaaaattagacctgatgaaaaagctgaaggagttatcatcccagccaagcaggaaacccaagccttttattccttctcaagaagaaacagaagacaatgatgtgatctgtgagtcatgtgtaacatgaaagtacaggaaacgttgaacttctgatatacaaatctgaaaaaattttatagtaacagatatcaggattaaaagtcaatatttattacctcttattatgagcaaataaatgcattaagaaaaccttgttgttttaaccaaatttttttgttttttatcactatgtttttaatattacagctaatttaaataaactttataaacaatctatctgatctcaatcagttttgacctcgaggtaagatttacataaacttttaataaccttgtataattttttccatctttcccaactttttatacacatttagttttatctatcttttttattccttcaatttaaaataatccttaaaaatctctaagcgaatttactttctctgaaacaaaaacccgtatagattttgcatacagaattgtttctcttgtatctagtagtcttaatcacatatatctaccaagatattaacacttagtaacccttattttaataaaaaacttaggaagaaagaaatcttgaattgtcatatagcagtatcttacatatgagaatgatttcataatttagaattatgtgttcctaaaacatattttttaaggtggattttcgctcttgttgcccaggctgtagtgcaatggtgtgatctcagctcactgcaacctccgtcccccaggttcaagcaattctcctgcctcagcctctcgagtagctgggattacaggaacccaccaccacacctggctaattttttgtagtttttagtagagatggggtttcaccatgttgatcaggctggtcttgagctcctgacctcaggtgagccacccgccttggccttccaaagtgttgggattacaggcatgagccatagtgcctgggctaaaacataagttttaaattggaaataacccagatatttaatgagtatctattatttaatttaacataactaaaatttcaaaaataggctgggcatggtggctcacacctgtaattccaacactttaggaggccaaggcaggagtatcgtgagaccagcctgagcaaatagcgagatgctgactctacaaaaaaaataaaagttagctgaccatggtgttgcatgcctgtaattaacaacttcttgggaggttgaggtgggaggatcccttgagtgcaggaggtcaaggttgcaatgagctgtgatcatgccactgcacttcagcctgggtgacaggcagagacattggctcaaaaaaatttcaaaaatacattaaaatgtcttgtatagacatttatccatttacatttacttatttttgacagtttatctagagtatttgtgagaactgaggtattagacaaagctagtcatcatttctaggttattttcttgttaaccatgttatagcctgtgaatatcaggtgttcacataagtgaggatttcaaagttaaatacaagggtattttaccaataactcagaaaattccattatttttgttcaacaaaccgtattaaattggtcttatgtatttaaaaaatcacataaacaaatattctttttttcctgtgtttatagctttataaccttcatgccaaaccctagcaccttaaaatacctagcaaatgtaaatataaaacacagtcaaaaatgtatgctgacaattctgaagacatttctatttttattttatcaatactttttaaattatttgcatttataaaagaactcttttgtctgggcacagtggttcatgcctgtatcccagcactttgagaggctgaggcaagaggatcacttgagctcaggagtttgagaccagcctgggcaacagagtgagatccaatctctactaagaataagataaaaaattgccaggcatggtggtgcatgcctattgtcccagctactagagaggatgaggcaggaggattgcttgagcctgggaggttgagataacagtgagctatgatcccactactgcactccagtctggggaacagagtaagaccttagagtaagaccttgtctcaaaaagagaaaaaaataaaaaattgtttcattcttttgtttttcttcagccaagtaaccttgaattggtaacaccacagacagtaagtcttatctcaacaccagtagacaaatcagcagattcaaagtaggcagggaaaaaaaaaaagataggcaaaagaactgagactttttcattttagggtttttaaaaatagtaactatttgagttctgaattttctttcatgtaatttggccgtcaggtttaaagtgtgcactagagaccaggtgcagtggctcattcatgtaatcccaacactacgggaggctgaggcaggtggatcacttgaggccaggagtttgagaccagcctggccaacgtgacaaaaccccatctctattgaaaatacaaaaattaactgggtgtggtggtgtgcacctgtagtcctagctattcaggaggctgaggcaggataatcgctcaaacctgggaggtggaggttgcagtgagccgcgattgtaccaccatactccatcctgggcaacagagcaagactgtgtgtcaaaaagaaaaagaaaaaaaatataaatataaatatataaatataaatataaatatatatatatatatatatatatatatatatatatatatatataggctgggcacagtggctcatgcctgtaatcccagcattttgggaggccaaggtgggtggatcacttgagatcaggagtttgagaccagcctggtcaacatagtgaaacctcatctctactaaaaccacaaaaattagccgggtatgttggcgtacacctgtaatcgcagctactcaggaggctgagacaggagaattgctcgaacctgggaagtggaggttgcagtgagccaagagcgcaccactgcactccagcgtgggcaacagagcaagactctgtctcaaaaaagtgtgtgtgtgtgtgtgtgtgtgtgtgtggctagaatggtccataatatatagccagctcgagtcccagaaaacctagcaagctaaaggttagagcttctcattttggccttttcaagattaaatctcctttagtaagcccttcccctctagggaggtacttgccggagcgctgcctgaagttggttttctgatgccctgttgtacctgatctgaatagtttatttctcattataagagctcagcaaagcaggcagagttaaaaagcagagacatgaaggctttaaaatcatggacttcactcctacactgaatctcaggtccccggaaagacagaaacaccatgggaccacagcaaaggcagaaggaggagtgagagagggaggtggacagaacaacaaacaggagttggctctcaatttttcacgtgtgccattttctttaggtttttctagtttattgagtctctttgttccaattgagcacacagataaactagaaatctcacaaggcttttgctgagaacatcaaagcctttaacctctgttgggccaaatatttagaccaaaaatacagatagacacacaaaagccagaaccagaccagattgagtagctcagtagctacagcctttattccctttattctttagggttcgaactcaaacgagattcaggattctaacccaaccaggacccccctggggtgaaactgaaaccccacagtctagacaaggttgggggtctttttttattttttatttttttgagatggagtttcactcttgttgcccaggctggagtgcaatggtgcaatattgcctcacagcaacctccccctctcaggtttaagcacttatcctgcctcagcctccaaagctgagattacaggcttgtgccaccatgcccagcacattttgcatttttagtagagacggggtttctccatgttggtcaggctggtctcaaactcccaacctcgggtgatccgcacaccgaagcctcccaaagtgttgacattacaggcatgagccaccgcgcccggcctgcttgttcttttcatttcatcctgatctccgaatacaggagagtagctgatttggtgttcactaacaagcacagaagctttgttacatttacagtgtcattcttggcaaaacctgaagttttgcctcccgggttcatgccattctcctgcctcagcctcctgagtagctgggactataggcgcccgccacctcacccagctaattttttgtatttttagtagagacggggtttcaccgtgttaaccaggatggtctcgatctcctgaccttgtgatctgcccacctcggcctcccagagtgctgggattacaggcgtgagccaccgtgcccagccagaagctctaatttcaatgatgattgtgctttttatctcttcctcagcatctgactcatgataaaatttcaggtgtcttgatggtatctaaatcagttgttgattcagtcctggagaaacacaagcataatctctatgccaagttataattttacctatttcccaactttttgttattggatctctccaccaaaccagttgttctgcttctctctttgcagctagtttctgtagatgctgttcagctgctggtaacatctggcctttgggcaggctcaaaaatttgaaagttaataatgatagattcaattgtgtatgggctacccgtaatccctgtttctccccctttttttgtttttattatcagttgttcatctgtatgaaatcgtaactgagcattttcaattaactgtgtggaatgaaccatgtatgaagaatcagaaatcacattaacaggcatatcaaaagcagtcaatacctcaattacagctacaagctccgctttttgagctgaagtatagggtgtctggaaaactttaccttttgatccagaataagaagctttaccattactagacccatctgtgaaacaacgaaaacgcttagcaggctgcaggttgtttactgcaggaattgtaaatgcaaaccgttcacagtcttgctcagctaaaagggtagtaaagtaacagtcttttaaatctgtgactattaaaggccaattttttggaattatagtaggagaaggcaatcctggctgttatgtttccataggttgtataactgaattgatggctcttaagtcagttaacattctccatttacctgattttttcttaattatgaacactggagaattccaaggggaaaatgttggagctatgtgcccattttctaattgttcagtaactaatttctctaaagcatccagtttctctttgcttagcagccattattctatccaaattggcttatctgttaaccattttaaaggtataggttctggaggcttaacagtggccaccatcaaaaatggtatcctaatctttggcaggaactttgtctttccgtttgaagcagttctttcaaaccttgcaatttttttctactcctataccagggacatgccccatttcgtgcatcatatgttgactttgagggctgtataattgctatggaattagaacttgtgctccccattgtcataataaatctctcccccataaatttataggtacagaagttgcaattggttgaacagtcccaggttgtccatcggtcccttcacaatgcaaaatatagctactttgatacacttctggggctttagcagtttccactgtgttaaattgagtgggctgaattggccacatggacggccagtgctgtagagaaatgattgaaatgtccactcctaccaaaaaaaaaaaaaattgtatctaccaaacctttaaagttctttccctggatagttatttcacagataggatgtttatcagtaatttgatttacccaataagctgccttgccttttttatttgtgcttccaaatcctccagttcatttaatttcactttttcccattcccacatacttcacactcaggagctgtgctatgcccactcctggctgtgctttccagggaaaagaagtagatatcacaatttgaatttcctcattgtaatctgaatcaatgactccagtgtgtatttgtaccccttttaaacttaaactagaccttcctaaaagtaatcccattgtccctcctggcaacggtccacagactcctgttggaaccttttgcgggggttccccaggcagaaggctcacagcttttgtgcagcataagtctactgcgacactatgggctatggtgggggacagataatgtacgggtgtgagggaatggcctgagctagaaatgccctggtttagaacagggcctgggatgggccccccagggagtttcccgaaatcgggttcccttgtttatcaaacttagagtgacactgattagcccaaagttttccttttttacattttggaaatatttcaggatcagcagttttcttttttcctctatctggtgacctgactcgctgattttttttctacattctttttagtatgaccatgcttcccacagttaaaacaagctacaggaaatggagtatttcctttatccactctcagtcctgccattgcctgtgccaacaaagtagctttatgtagattacctctgatatcatcacagccgttgatataatcaactaaatgtgctttccctctgataggtcacagaacagcctggcaatagggattagcattgtcaaaagctaataactgcaacactatatcctaagcagccaaatctgcaatcatctttttaagagactcctgtaaccaaactataaaatccacatatggttctcttggtccctgttttatagcactaaaggaatggtattgttctccacatgaagtgattttttccaagctctaatgcacactccactaagctgttctatggcatcatcttgcatgaccacttgtacatgtaaaccagctcagaaaccaacccctaaaagttggtctgcagttatattaatttgaggttgggcccaggtattgtgagcagcctgaatggaagcttcatctgcccactaagttttaaagtgtaagaagtgagcaggagttgacaagctcgagtaatagtgtcccagtcagtaggaatcatccgactggaaacagcaacattctttaacggtcccatttcaaaaggagaacctggtccatactgatttatagcttgtttaaattttttgagtaatttaaaaggaaaaggctcaaatgtagctataatatttccctgttgatctggggggtgtattctaacagggagctgccaagcctctaaatcccacttttgttttgcttgctgtattcctgcctgaatagaactaagagcagtcgctcaaggcgctgctcgaacagtcaccagggcaactacttttcacccagtgtcctccagaaaagaaagatctggtgggtcgttttcttcaaaataataatgagggggtgcagaagggtagggatgaacctctccctccttttctgctttagctttaggtggcaaataaacctggtctgtaacctctactgttactttgttatactctccttcctcctcatcatcagtgtgaaaaagttccaaggtagaatgaaccacagcccacacttgtcccattgttaccctgatgcttccgagctccccttcttactcaccacggggattgctttaagagtactcaggtgtcctccagctagttccacattctccaatcgttgctccagcgatcctttgacctgtattcgagcccccatgaatgggcaccacttgctgagaccaggtcggtcggggagaccctaatccagcagcgctagaggaattaaagacatacacactgaaatatagaggtgtgaagtgggaaatcaggggtctcacatccttcagagctgagagtcctgaacagagttttacccacgtgtttattaacagcaagccagtcattagcattgtttctatagatattagattaactaaaattatcccttatgggaaacgaagggatgcgctgaattaaaggaataggttgggctagttaaccgcagcagaagcatgttcttaaggcacagatcactcatgctattgtttgtggcttaagaatgcctttaagtggttttccaccctggacgggccaggtattccttgtcctcattccgataaacacacaatcttccagcgtgggtgttacggccatcatgaacatgtcacagtactgcagagattttgtttatgaccagttttggggccagtttaaggccggatatgagggggcttgttcccaacagttcctcagggtaagggtgccgtaactcctgtggggacctcctttggtggctccccaggaagtaaggagatgggaattgttctgtagaggtctacagcagcactgcttgctgaggcgggggacaattgttgtacatttgtaagggcagtggctgtgctgggtatgcctcggtttgttgtggggctcgaggcaggtccctcttcctatttcctgaaagaggttgtccatctttgctaaatttagaatgacacggacttgcctagtgattgcctttcttacaccagggacatacactgggacttttctgttgattgatggtagtagttttcatcttttgaattcctttctgcattcctttcttgtgtccaatttgcccacaattaaggcaagagcctgagaaatgaagcatattttttcttactcttaatctagccatagcctgagctaaaagaatggccttatgtaaattacctccaatgccatcgcaagccttaatatatttagttaaatgagccctctctctcagggatctaatagcagtttgacactctgcattagcattattgtatgcaagaagctgtattacaacatcctgagctgttttgatcatttacggctttatacacagcctcttggagctgagcaataaaattaatatatggttctttaggttcttgtcagacagaactgaaataaggatacttttcccctgtaacatttatccttttctatgcctgtaagcacatgaagcacagctgaacaatggcaacatcttccattactgcttgattctctaatcaaacccagttagggccaactcatattaactgatcaaagaaaacaggcacaggtggctgcacgtgtgtgttttcttttgcctgagtttgagcataatattacagaggccattacagaggcctggttttcttgctccaattcgaggtcattaggtaaactcaccaagatcttgtagagttttaaactgcaagtactgagatggagtgaaaacaggttttgtcaaagtatcctaattatatggtagtaatgtattatcaagagccatattttttaataaagattgcacaaaaagacagttcagtccatattgactaatggcttgcttaaattctttagtaacttagaagaaaaagcaggctaattagctatattctgtcctacttgctggattatagtaacgggaaattgccatgcttcaaggtctcccttggctttagctttttgaatagaattttgtctagcaccaccaactgctccaggttttaatgttgtaactacaggagcagtaagtttttcagctaatttattttctcacccatttaggggagagagaggaggtggccattcacttaattcagcaggtggagccaacgggctagtaaaacatactttttaaagtttttctttcttttctttaatctcctccggtagctgctcctcacactcagaatttgaagttagttttttacactcatcctcctcttcctcatctgaatctgcctcatcatctgtttgaaatggctgaagggctgcctttattagtgcccacactgaccatatataaactggaatttctgctccatctttatatgcctattaaaaatctcttccaattctctcccattcatccaacttcatagtcctttgttctggaaaccatgggcaaaactgctttactgtactaaagagtaataacaaattctaagtactaactttcactccccatctttgtatgtcctcgggtgtcttttgatgatgtgtcctctgctttcatatgctctagccttccttcaccgggtctttgtcaccccatgttgggcgccaggaatgttggggtgatcagacccaacactaggtcatgggggtgatgaagtccggcagagtcaaaggaatgagaaaaagacagtttgagagagaaagtgggaccaggagaccatcacgagtatggagtctgcaaagtccccaagctctgggagcccacgctatttgttggtgctcaaacaaagaaacaggtggtgaggatgtgggggttgaaaggaaatggtgtatcaagtgaatgagaaacatatggccctgcctcagcttctcttccaacactcagcttttctcccaacacattccccttatgaacaggaataaaatagggatgcctgttctccccattcctgtttaacaagtcctagccagagcaagcaggcaagagaaagcgataaaaagcatccaaataggaaatgaagtcaaattatctctcttcactgatgatatgattctacacctagaaatacctaaagactgtgccaaaaggctcctagaactgataaaaaaaactttagcaaactttcaggataaaaaaaaacaacatataaaaagaagtagcatttctgttcaccaaaaatgtttaaactgaaaggtaaatcaagagtgcaatcctgtttacaacagcaacccccaaaataaaataaaataaaggaagaatatgtctaaccaaggaggtaaaggatatctaaaaggagaactacaaaacactgcagaaagaaatcatagatctcgaaacaaatggaaaaccattccatgctcatggattagaaagatcaatattgttaaaatggctatactgccaaaagcaatctacacattcaacactattcctatgaaacaaccaatgtcgtttttcacagaatcagaaaaaaaaatattctaaatttcatatggatttttaaagagcccagacaaccaaaggaaatctaagcaagaagaacaaagctggagacatcacattacttgacttcatactataccctaaggccacagtagacaaaataacatggtactgatatgaaaacagacacaaagaccaatgaaacataatagagaaccccaaaataaacacatgcacctatagccatcagctttcgcaggataacacaaagagagccaagtggcacctgcacattacactgtggaagaaaaacccaagctcaagaaaccccaacttgtgttattggaagttcacttggctgtatgcttcccaagagggagaaattatctgcattatactagacagtaaataaacttttcctttgttccagaaggaggtactggttttctattccaaggctgttttctatacaaacatgcttgaaaacaatcatttggaacaataaattcagcgtccatacttgcaaaatgtgcgtaaattaaagacccaaaaattgtttctctaccaatttctattttttaaaaatcaaattttccccatataatatgcttttaatatgtgatcatattctgaaattgtcttagcatttacccccatttctgagtccagaaggatacaatagatttaatttaatttagtaacacttcaaatagtagtgattgtaatagcagagctagtttgtagcataaagaaaaaataataatattattaggtgacacttacaaataatgctagtcaccatttctaagtgtcttgggaagtacagtgattattttctttctttctgactcttttttactttattttttatttttttccataggttattggggtacggtggtatttggttccatgggtaagttctttactggagatttgtgagatttgggtgcacccatcacccgagcagtgtacactgcaccctatttgtaatcttttatccctcgcctcccttcctattaaataatagaccagaaataatgggtttagaataaatgagttcaaatgaattgtcaaacgtatgtgggaaaagtggaatcagtttttgagaaaaagcaaaaaactcaacagaaatgctgataaagcatcatcccttcatggctagagctgccagtaccccagaacaccaaaatcagctagggaaattttgtagaagtcccagatgtactaaatgttctgtgaatacacagagatataattataactgttacctgcatgtagagtaaagatgagaaggcattggtcatggtggcagctacctcaggagttacaaagcagacgtggtcccaggacagtatatgtcagggcaaagctgtcctcggaggctattaggagctggttatggcacagacattgtaagtcagatggtctcattactttcaatgacaaaaccaaaattacttttgcatcagccaatacaacggcctggccagagcacagaaaaaggccctgtgctgttaggtggggacctctgatgcagcacaattccttcattcccttctccgaaaccccctcttccaattccactgaagagagaatctgatggaagtgctgtgtaagcaggctcagatatatctaccactatagacagtagaggtgattcacaaatccaagcctatcaaatacatcataaataagttacacgtttaattttttttgaaattagggatcatgatatgaaagttatcagaatcaaaactgtcactaatgtttaaaaagagaagaagaaacctgaacaaatagattcagagaaggccttgaagagagggttctcatgcttctaggcctgataaaaactattacaaaataccacaaaatccacaaccttgcacaaaggccatagcaaccttacacaaaatacacttctgtgaggacatctatccaggaaccgcctgcccaaacttcaactgatattgaccttgttgttgatctttatagtcaaaggtaactatatcaaaacaattatagaagcctcttcattttcccttatttatttttttctactcccccatacttccaggttgatcgcttttcttttaaagaccttgtcttcctttaccatttgaatctatatagtttgctttgtcatgcatattcccattgcagtgccctcctccctaagatgtgtctttttcctttagagagcctttctctgtttgttatttaggtttacaatgagaaggcgtgtaaagtatttttactgtcttcctaggaaaaaatcactgacttacagtatttatatttatttatttacattcctggggatgaggaattaaagatttcacaaattttcttattgagaagatccaagttttcatgtgagcaaaactgaatatgtaaattgatatgtaaattatgctgcagataatatggtcaaatgtttacttgtatataatttgttacacatgaatattgcatatgtaagataatatactaagaaattatcacatttaatgaaatgctttaatcaaattactgattgaacttttgatatcaatatctttttcattgtttaatccatctttagggtgaacagggctttataggccaaagttatcacttctatctaaactgtctgagttacagaactttttgaatttattatgttgtcacaggaagtttcttattgctgtttaaaggagtgtctctcaatatgatgcagaatgcaaactcactgaagggcatatatcctgagtttctgttactgaagccaaaggttgccaatttcttgtagatcctgctagagttaaacttcatttaagtaatcattaaaagctgcatttattccctcacttgaaattttgatttcacactattaggactaatcctctaagtctttgctaagttatgttcctctttttcttgtagcttgactctgatgatctctatatgcaacatcaattgacataaattaaagtacattcagggcaagagagtttctttaaatattactttgttattcaaaataatcacaaaagcactcatcgtaggaaaacttgtgaggactcaaatacagggaaatactttttctttctaaggcacaattctctaaagaagttcaccttaatttgaatatacatgggaaaatatccttgttcactaatagtctatattcactctgttttcttccctcatagactagccggttcactattattctccaaatgatgtgtgcttctctagagtccaggctatctgcatatctaatttttcccacaaattactgttttgaattgcactgaattcaattcaaggggatgtcatttataaacagtgcaaatatatactgcacgagggatcttagaaatcatacacatggtttgatccataagctcatatgagcgtgcaatgtcaacttttttcatgtttttttaaatccacttaaattctattttaagccatcatctgtctgtgctgttagggcagttagccttcaatcattttaagatgctcccctctaagtactgtgatagtgatagagatatcaccagtcaggtgtcctaggaagccgactccgagttggagatttgcatgcaaggaggttgaaatgatattcccaacacctgtggaagagtgaaagcaataggattgggtggagcaggaagtcggctggaatgcaatcactatcatggccgcagtccactctacaagatcttggtgagtttacctaatgacctcgaattgtagcaagaaaaccaggccattatatttctgtaccaagcagttctcggatgtgggatgccttgagaagggacatgaacttggatgaaggaactttactgtgctgtgagtattgttgccaggagtcagctgtcaacactcccaggagacgggaaattatgctttagtcactgaggcggcatgtagtgtcagaccacagccttgttaaacagagccagaatttggaggatggttggtgggtttaacatttggggcttgacatcttgtcaccacaagctgctgctggcctcttccttgtccatttctgtgtgacctgttaaggagccccagcttcctgcttcttctttaccatatttggaatgcaaaaatctacacgtaatttggcccatggacccttctgcttagacatatccttgtagctattttttttttaaaagatgactatgccttctagaatatttctaagaaactgcctaagtcaccactgctcaccaagaggcctttgttttttcctcttcttaaccatgggaaaggaatgtaggagggtagggagtggatattttctaacctggaaaaaactcattttaccctatatgatttttgttaacaaattccttctttgcacttactccacaatctttccaaattctcccaaatgctcaagcttttaaaaaacaaaagacagaaagcaggttattaggttttccaacaaaccttttctttctattcctttacatcagtgggcttagaataactctgctcctggaactgggaaaggcacttgggaaaagaaagaaaaaaaaaaagctctcaaagtttaacatcacaaaacattatagtcactgctattttattatttatttatttatttatttatttatttatttatttttagatggagtcttgttctgccaccaggctggagtgcagtggtgcgatctcggctcactgcaacctcagcgtcctgggttcaagcgattctcctgcttcagcctactgagtagctgggactacaggcgtgtgtcaccacacccagctaatttttgtatttttagtagagacggggtttcaccatattagccaggatgatctcgatctcctgaccttgtgatccgcccgccttggcctcccaaagtgctgggattacaggcatgagccaccgtgagtgaccttgctttgtaatttttacatcatatatcccctgtgttagaccaagagcttgtaaaaaccagaagacatacaccatttatagttcaattagagatgttcactgataaaacttattcttccatctgagggtggtatttgtagttacagtaatgtagatgacaatctaagttatgttctatgaactgtgtcactgacatctcaatctacagctaactttaattttttaaaagcagaggagtgggttgtataggtttagaaatacattcatcaagctagttaagtgagatattcaaaccttcaactcacttgaatatttaccaaattgactattcattagctaaaggagccatataaacaaggtactttttaaaattcaaaattatgtaaggttttgtttcctttttatgctgttatgaattggattgtagaggttataaggtaaaataaggttacttttacagtaaagcatacaacacattgtcacaagagggcagcctttgaacatgaatttcttctcaggcattccttgaaattttgagacagttactttaattaacacaactaaataataaaacactacagaggatctaagaagatactttgacttatgcatattgttacttttttattactgctagtggaagatgtaatctacaaggaaggcaagggctgaatttgttttatgtaagaagacaaatttctttgggttttagctttcaaacaagatagtaggtcaatgtctaaatgagtgtatcaaagttctcacactagcacatgtaaatccacctcttatctacccaaaactctaaccaagcaaaggcaagttggaagaatcagacaaatgtaagtgcctaggatacataaatgccactggattttatgtttttaacttgcaacctcccaagtttcactaagagacatgttatttggagaggttgctaaagtgtagttgtatgatgtctctgtgtatggttggtctggacctctttctgtccagtggttgccctcaattgattagagtcacctctctaaagatcatgcttacgtccctggagcagtccacagcactatcaatgtctgacctccacctttttccaattaatatttctgtacttactgaattggaaaacatacaggtgttttttgcctggtcacttgtggttttacaacactccccccgcttccgcaccactgccccaggtgattttgttgccagccaaagtgtgagaactactggcagctgctggcagacagcagcaaaggcccaaatcctcggtgtgatttcaagacccctatctagttttcagccatatttccttctccttctcacagctgagcccactcctcctgcctcaccacctgtaggctatgctttccagcctgtgtccaggattagtcctgatgtaaggcacgtggggtttaaggatctctctcttcagtcttatttccgcaccatcgctgacacatatattccagttgtaatcatggggctacctccttttctttccagtcccatgctcattttctctatcacattctaccttgtaataacctaaatcttctggtgggcaagcttcttcctcaatcaaatttgtgtttatgattgtgttggggattggcttagtaatccaggtactgctgctgccttgaaagcggagactgcatccttctgtctggatatcttgagtttctggattgtaaaccttattaggacccatttttcctagaattggagcctctactttgttcttgctactttagttcacccagaaatcacgatctctgcctgaatttcaaagtgttggctagcttaaatatccttttgtgagactttcgtcttccagcggggtgattttttcatcttacataccattgctaatctttttatcttgaatgtaattgaaatagttttaatctgtgttacaagcaacaagaaccccttttatgagatgaagaggccaggtcagtctcataacatgtgtccccctccgtgtgttgaatttatgtcagagccaggttctttcctatttgacgtctctcaccaaattccagtgtttatgtcctaggaggtgcccaataaattctagagttgatacaagctgcaattttagagaaattaaattagcaagtaaaattagattatatacaacctaatcaacttttttttttttctgaggatgaccaagatttgggcttcagtgacaatagttgtcccctaaatatttatactcaaaatctaggatcaccagtacaatgttgaatagaggtgatgaacacacacatccctttcttgtcctaatctatgtggtttaaacatttacgctttcaccattaaatatagtattgtttatatgttttgttgtggatgctttccatcacttcgagaaaatttctttatctagcttgctgagagtttttttttttttttaaatcagcaatagatatttctccaaagaaaatatccacatgaccaacagatacatgaaaaaaatgctcagcatcactaatcagggaaatgcaaatcaaaaccacaaagagatattgcctcaagccctttagaatggtcttattaaaagaaaaagataacgagtgttaacaatggggagaaattggaacacttctacagtgtttctgggaaagtaaaactgtgcatcctctatggaaaacagtacggtggttcctcaaataaattaagaaagtagaactagcatatgatctagtagtctcacttcaggttatttatctgaaagaatggagattgggatgattctcaggctcattgcagcattatttacactaattaaaatgtgggaataaggttaatgtctattggcagatgaaaagataaagaaaatgtggtatattcatacaacggaatattattcagctttaaaacaagaaagcccgtcaatatgcaacatggatgaacctagaggacattaatgctaagtaaagtaaatcagtcacagaaggacaaactgtatgattccacttgtataaagtatctaagatagccaaattcattagaatcacagattagaatggtgatagctctttaagttgaagtcaattttgcattcctaggttttgtaattttggtatcaggattctgactcataaaacaagtttggaatttcccccttctttatttctgaaataatttaaaaattttatttttttaaaacgtttgaaagaattcaccagtgaaattctttagatctggggtttgcttatttttttatttatttaattttatgtttttatgtgcaggtattttacaattaatttaattactttaataaatgtcaattacttcctatgttccattaaatcttgtgaaattttttataagtttttttcaaggaagtcaccctttcatccaagtaatgaaaatttgtatataatgtttcacaatattccattatcttgttaaagtctcttgtgtctacaactgtacaatctcattaatccctgatatgtataatttgcgttttctttctttctcacagaactaacttttggccatgttgattttctcctgtttctgttttctgtctcattgatttctaatttctgttttatttcctttcctctacttgttttggacttaatttgctctcttgttttagattttctttttaaggtagaaattagttcacttgttttgaacttctcttttctagaataagcatttatacaaaaaatttactctgggtctgcttaactttatcccatacattttgatatagtatatttttatttgtattcagttcaatgtatttaaaggtgtttcttatgatttcttcattgagctaaagggcattttaaggtgtatttaaatcttccaatagtgtagactttcctgggtagcttgtttttacccatttcaactcattttcattatggtcagaaagcatactttccatgattacagtgttttgaaacttcttgagagatattttgtggtctatagcctattgataaatgtttcatgtgtagcataatagaacatatattctattgtcttggtcaatatcgattaggtcaagctgttgtcaaaattattttatcttaattttctttagttattctgtcagcaatacagcattatgtcttcataattacttgacattttgtcattatgaaatagctgtctgttgtaatattgctcgtttggaggtctactttttcttatattaatatagccacataagatttcttgtccttgttgtttccttggtatacttggaaattattttactctcaacttatctataccataatatttggcatgcatctcttataggtacttttattatccagtttgacaatctgtgttttatttggagtatttaaattacatttgaaataattactgaaaaggttggatttaagcctactatttttttttttttttttttttttgagacggagtctggccctgtcacccaggctggagtgcagtggcgggatctcggctcactgcaagctctgcctcctgggttcacgccattttcctgcctcagcatccggagtagctggtactacaggtgcccgccgccatgcccggctaatttttgtatttttagtagagacggcgtttcaccgtgttagccaggatggtctcgatctcctgacctcgtgatccacccgcctcggcctcccaaagtgctgggattacaggctgagccactgcgcccagcctattttgctcttatgttctatttgctccatcattttttgctcctctttctttcatgcctttttatattaactgaacaatattcagcgttccattttaattcctttattggcattttagaagaatatcttcatataatgtggtggttctctagggattataataaacatcctgggcttatcgcagtccacttagtgttaatagtcagcgttttcatgtaacataaggaaaagttgcggcaaaattgttgcgtttagtctcctgtcagagctattaatttagaatattttacacacattatcaatagtacacttaattttttattcaaagcatcagttgtttgttataaaactaaaaaaaaaagccttagtttttcacgtttatgcacatgccattcctagagcttctccttgcttcctgtaggtcagaatttccgtctgttgttatctttctttagcctaaaaaatttccgtttgcatttcttgtatcttggtctgctaatgacaattgtttgaagctttcttttatctgaataaatctttcttttctcaagaattactttatctagttatagaatttggagttgacagttttcttttgaagatgtagtttcattgctttttaaagtgtcatttctgatgataggtcatctgtctatttgtttccacggatgtaaattattttctccctccctttagctactttcaagatttactcttttttttgcccagtggtttgactatggtatgtctacatttggttctctttatttttattctgttctttgagtttcttaaacctgtaagttgatatatgctgacaattaggaaaacttttggtctttactttttcaaatagctttttctgtctcatttacttctctactctttctaggactccaattatattagtgctagactggccctatttttattatttttcttcgtttgtattaactgtattgggaaattgttcttgatctgtttttaagtgcactgataattttttgtgccatctttaatttactggtatgtacataaaatgacatttttatataagatactctgtctctcagttctaaaatttgtcctattatctctttatcatttttacttctctgttgagattctccatatattccctcttatgaccatctattccttaaatccttgaatatgcttataatagcttattttaaatttcttatattctaattccagcgtgtgggccatttcaatgtcttaatccattgtttactttttttgttatgtgtcatattttcctggttctatgtctaggcagattaaattatatgttagattatgtgtatgatattttgtagagataggtttgtttattttcctttgaagaatgactcttttctaacattagtcttctttccgtagtcaaacaccaaactttcactcctgagctatatgcaatggttgaaatctctgctctgtactagcaatttagctgttgttttctgctggattctatggagtctccttttatgaatgtgaaatgtagcagccatcatatatttgaatgaagttgaagtgctgattttagatttttactctgtgatattctcctctgtgactttcagttgtgtgagatgtcctcccatgtcattcaaatttcccagttcctcttttctgtcagcctggaactctgtgctcttattcctcaagctagtaaaactcaccgctttactcgtagacatctaattttgcacagactgggaagcgtcatcaggtgtgaagttgccttgatgcaaatttaaatcattgcaattttctttattcaatggtcaaatacttcatcattagtggagtattctactatttctgcctgttttctgtttctcattaccatcaaatgtgtatttaatttttttagagttaatagttttttccctgcatttggtttagacctgagctactaccatattttgtaattcaaactttttgtctaacaatgttttagaaaactctttatttggagggaattctcaaacttctaaatactctacaaacattaggatcagggctcacattcccagtttcccttgtagccagatgtacatatggaacatggcctcagctaatgaagcatacccacatatttgaaagtaagaaaagtgttaagaggaagtgtagatatcattttagttgatgcaaggatggaaaaaaataaccaactttcactggtgaactttgtcttcaatcattgttttcccgtgggtaagtggctaattttctggcctagaggtggaattggggtgttggtaacaattgatttgatgataacctgcttttgtctttttaaaaattgctaatctaccattgtttctggtcctgttttatatttatgcagtgtataatgtctcatgcaaaatttagttctttgtttctcagcttaaactggattttgatgggcagttttcaccttcaaatgaaagaaatggctttggttgatgttagacaaaaataacaagaagaaattaaagaaatatgtttgtcctcttgtaacattaaataaatgaaactgaaaattcaataattctgcttcataaaaaaatagaaagtttctactggttttcattatttttgaagctgtatcattaaatgaaatttctgcctcatggaaggtttttagaactatgtaataataccatacagaccattaggagagaaatgaataaagactgaaagaagtaagcactgtgtggtaacatagatggcgcacagttgtgtgcgtggagccctaatacatttgaccatggaatttatacaataaatgttagtttcctgtgaacctgctaattaatatgacttttgcagacatttccttaacctaaacagtttgggtttcctgtatatagactgcatgtattctcacctttaacctttccataatcttccctaattacagatgtcattggttcttaacagcaaaagaacagcagtagcttataaagttatattatttgttttttactaatatgtgaagtgattttgtctttcatttcacctgtagagctaattatgtcttctaggttaacaaaaattccagatcataccatcattagtttaaactttacaatgaaatcattatttctatttattactagcctgcattatagcaatatttagctaatgaattctcaaaatatttcttgaaaggtgaaagagtacctcaagtaaatggtgtaatttatttatttatcagaattttaaattaattgttctgtttaatctcaaaggggtaccaatgaagtcagggcataaggagtccgtggttaataaaatggcaagaattaaaaaggattattacattttttcctcatactatgatgcctataattttttaaaacagtagaaatgtttaatttttaaaggctactagtgtctatttcattcaaagatgtgagctcttcagttcaacttgttgtttgaaatttgaaaagctttttcttgctcttgttcaatacagttatttaacagtccaggcaggcctctggagttacatatatgtatgtggctatgcgtgtatatatacacagaagtacaaatagcatataaacaatttacataagacttttgcttttgatgaaaattcttctaaaagtgaatataaattaatagcatatggagcctacaaaaattgtctaatagggaactaggaaaagataatttgtgaagaaagagttcgctaaaacagactttttatttttacatctaataacattatattgaagggtttccagaagtataaaatgttatagggcacttatcctgagacacacgaaggagacaagggatagagctaggatggaagtgaaaataaaggacaaatagagatagatacttaagtggaaatgaaacactgcatgttctcactcataggtgggaattgaacaatgagaacccatgcacacagggaggggaacatcacacaccagggcctgttgcggggtggggggagggggtagggatagcattaggagatatacctaatgctaaatgacgagttaatgggtgcagcacaccaacatggcacatgtatacatatgtaactaaactgcacgttgtgcacatgtgccctaaaacttaaagtataaaaaaaaaatcatcaaacaggtggtaatttcaaaacatggctttttcaggcagcaaattttctgaatgtatcgcaaaagaagataaattgcatgtctatgtagatcatgtcaatgaaataaacaataaagttacttattcgaatattgaaagtggttgatagtaaataaattatttatatttatggtaaaagcaataaacttgatttttagggggttcaatgacttcctgaaaatatcctctcacagattttctcagagtgtctagttggcaaaagcgcagctccaaatagctatttctgtcaacgtctacagaacatttacagtttgatttccaaaagtttccatttctactgaccttacaaatttgtaaagtgaatgcccaccatgacaaaatattaagtgataaaattaattgcatcctacaagtgaaaatctaggcaaggaaaatcttcttccttcttaatgaatgatttttatgtctcttcattcttgtccttctaggtaaagcaacactctggagaccttcttttgaggcatttcaccaccagagtaagtgtgatgtatgagtaattagtccacccacagggagctggtgaaattaaatgggaagttatttcctaactggcatatcttggagtaaaattaatctaataacagctttcataagagaacataagcttaaaagacaacatttttcattcaactttaccaaacaaagtgcaaatttaggtgtccagttgtgaagtttggttgtgtgtggattgtacggtgaaggtaccagtggacaacagttcctcatcaagcaagtttatacaaaagcttttggacaagtccaactctagataaaattcgaaagtatttcatgcttgtgttcagagtttctttttctctctccaaggtaacccacatatcaaaagacatatgggttgtgggtagaacttcctaaaattgctggtgagaagtgtgccatgcataagcatacttcactagcttgaattttctgttagtctcacaggcaacaattacaatcctgtatgtttttctatctccagacactcctgaacataaaaagaccaagtaacatccctggttaagatgtgtacaggttccaagacatgtctaaatatattcaccaagaggtttattattttcacagtggcattcactaaatcagttgtcagtgtagcattactcaaggaatatgcagggtctttaatttatcaaagtttggagtgcaccccaagttggatcactgaagcacataactatagataaggtcactcagaagcacaaatccaggtaataaatatccactagtagtttatatgcatttagcaatttgaatgctgtgaagtgtagcccagaaaatcaatcgacatggagctattaaagaggcattcatggcacctgcactttgaatctcttcagactcaggttaaacaggagacatggtagctcatatatactgcaaaaacccttcctctttccctttttatctatgaacctgcccttttcaatgttatctagatgcctgaaggtatgaatacccttgatcttggtaaaaaatggtaccacccatcagcaaaatctcactgatcagtgtctatgttacctcactgagttagccttttgtgttgttgtggcccagaatgacaatgttgacacaatccaaaccagtagttggaaagttaatgttggatgcgtctttgacaattgatggaatgacctgaaatcaaatgtgaggcagtggagacagaagaatgctattcaggaagttagtgatctgtggagatactaaatgaaatatctggaaggaattgtaatcttgcaactatgcttttatgtgttttttgacataaacagtttctatttatggtggagctagagtgtccatttcccatgaagttcccatagtgttaactaatacagtcatgtgtcacttaatgacaggggtgtgtctgagaaatgcattgctggacaattttattattgtatgaacatcacagagtttacttacacaaacctagatgctatagctgattacatacctaggttaggtggtatagcctattcctcctaggctacaaaactgtgcagcatattactgtactgaatactgtaggcaattgtaacacaacagttaagtatatctatacttacttatatctatacagtaagtgtatctatacatgtctaaacatacaagaggtacagtacaaatacagtgttatgattttattgcaccactgtcatacaagtgcactatccttgaccaaaatgttgttatgtgatgcatgattgtaacaaaagaattaattaaatataatatcgaagtgcctattgagatttcaatgaagaaaggaatatttgtaaattctgattaccttaagtgggaattgactttcttcctgtttccatggctgttcttgtgaaagagcatagctttccaaagacctgaaatctctgacaaatcttgtaattctctatagcctgcattatgaagggcacctggtatcaaaaggggcaaaatggtagattataaagacctgtactttcttgtcacttcctaaacatagcaagcattggtctatcttgaacatttctgcagttataaatgagccttgggtcatgattttctgcctttttatcatagacaagatttaatttaggagatgtccttttaatgtgtaatgtgaatagtaagtgacacttatgaagcctattttcttccagccattttaattgtcaaatctgtccagtcaagatgcaatgttagaggcttcactgacaacaccgtctgtgtgtgtgtgtgtgtgtgtgtgtgtgtgtgtgtatacatacatatgattgagcaggatttattgtaagtcaaaacagtctcaaatttcttaggacaatacagcttccttggccattcccttggagctctgagttgaggagctggtgatgtgtatttcttttgcatgttctccacattatccctatgcaggccttccatgggcttggttttggaaccagtgatgaagaagatcattagaattgttgttctcaaaaagattcctccattcttctgtataagcaatggcaattttcccagaccaatatttcttcttttgaaatggtaaattttgaatattaactggttagtataatcccataaaataacaaagtttgagccctatgatctgtgttttaggctcaagttgtgttttatgctaaatcatcatttactccttgtatgatctttttttttttttgagacagagtctcacactgtcactcaggctggagtgcagtggcacaattttggcttacaacaagctccgcctcccaggtgcacaccatccttctgcttcagcctcctgagtagctgggactacaggtgcccgccaccacacccggctaattgttttttaagattaaggatgaaataaaagctgctcccctatattacattcataaatcagaattattaaagcaagctatttatttattagaaacacatactccaaatttagcatctaagacatgacagtctttcaagagacatcaatttactttttagggactatagctgtatttgtattcatgttattggtgtccataatatttcattagatgttctgggtaaattgataaatgaaaataatatatgtgataaggagaacaacctaggcctcctggagggccccttacaactcagctggtgttagcagaaatgcctgggagtaacagtgagaaacaacctttcaaaagtgttgagcaatttttcaggcagaggactatatataccaatccaggcagcaagataagtggaggtcagttaaaagatcagtatgtgattacattttttttttttaggtttctactgagaggaaatataacactcagttattattttctccacatatctctggttattttgtcacaaccttttatgtaagctactaccaaacactgggttatccaagatctatgggtcgtattcaatatttgcttttccctcaactactaacacatttgattccctttggaactttctcccctatttctcctttcaacctgttttctccaaccacactgagttaataagcctcctatatactctcataacctgttttatctaaagagatttcctttttctactattatacccatctcattccctaatttatttattcttatttctcactctatttttattcttttaggcacagctcatgtctcatgactttcaaaaagtttttcttctgatattcccagctcgaattaggtacatcccaatcagtttccttagacttacaactctacatattattggcttacaatctgtcttaggctgggaattagctccttgtaggcaggggctagaatttatttactcttatgtccataatgcctgacacaggaactattctcatatacaaattgtagggtcataattcctgagaacatatgtacattgtagtgactcataaaggcttgaaataaatttttaaaatgattaattgggaagtccatgaacttgacatcttgatgtagaagaaaagcaagggcagatgaagaagttatacaggatacttgaaataccagaagaatataatcagagagcaatacattaatcctagatttttagatgtgaagaagttctgagaaatatttgaagacatggctctagggatgagtacataacagagaccagtagccagagtcagagcttttcagagtgaagaaattgcattgcggggggaaggactcttgtatactaaatagaaattgtcattaaatggagactaagcaagaggctgatgatctgtggatgacagacgcagaaaggtgtggagatagaggtaaatgccataatctacaaagaagatatttttgtgccagaaagaaataataggtctagaacgtaataaaagataaatagttaactacattgcaatgtggtctgagaactcactgaaggcatagccattgatattaacttccacttcgcttccagacaaaagattttaaatatcttaaaaattccatttgatattgtatgattcatcaagacagaaagtaaagctgtagttgccctgggagggcggggaatggggagtcactttttaatgggtacaggatttcaattttacaagacaaaaagaattatggagatgggtggtggtgatgcttgcacaacattgtgaatacatttaatgacactgaattgtatacttaacagtggttaagatgcaaattgttgagtgtgttttgccacagttaaaaaatggaaaacaatagtatttgaagatatagcccatttcatctggtagctagctgtatgtgtctgctcagctgtggatagatatttatgctgtttctgaactggaggttactggtattctctaagatataggaaaattgatcttatgtggctaactgaggtggatatagttgtatcagtcagacagtaatgatataatcatgatagtttacatttaacacaacttacatgtgttatactttagaaagcacttcattcatattattacttcataccattttccccttaccatatttgtctctcctttctctgctgacttcagaaaatgtctcttccacactactcaattcatctccttattttgtcaaaattttaagtctcagagtctccaaaaaaaaaattccagacaagtctcatcagctttcagtcattgattaatcgatatccttagaggctttcccttccccttctcaatttaacatagcttccaaatacacttgccaataaaacaaagttgtttatatggttttgtatttcttcctgctgaattatgaacattttttcatattgacattgatttccatctggccatgaaatactcaaggtgaagaaaatgaaacaaaattgttaatatttatcaagagccaggcactgttttcagtgtcctagaagcataaactagtgtaacgctcaccagatcatatgagaggcaaaaatggatgaaactataaaatcaagacacagagagttaagggaaatttcccaagatcacacagccactgaggatatgaactagattttgacttcaggctatttaccccagaacctgtgctttcaaccatcatttgtactgcttccctaaattactcttgagtacactgtgacatcatatttcacctatgacactgattatctggggatctttgcaacttattctgaatgtgattcagttttcttttctgtacagagataaagtcagtatatactccatagatttgttataaggattatatgaaatgacacatgagaaggctttaaaaggacttggaaagaaataagcttttttgttttcaatcatttttcaataggttatcagtgttgtgaatggttcatgaaaaatgactttgggctcagtgagtaactgaaatgttgttgcttaatagtgtgtttaatattaatataatagtaacaaatgttgttattgttgagtaatacttatttggtttttcactgcttttcttttctagtgttttagtcagagacttcttaagtctcctcaagtgtgtacacatttcttaaatttgttggaaagtaccaaatttaagatatcttgcatttttttcttccttagtaaacactaaattccatcacgcagcagaaaaggggctctgttattgttggtacaatggcttaatattcacttttattccctgtatcgtagttctgatataattgctatttagaataaaacttattccttattatatgcattcgtaattataaaatttgtgttttaatgccttctacacatatactgtgtttttctttatttccttatatctcttactgtttcatgatcctggtatttgaaatctcattaagtgttgtttggggatttgctgggaatgtcatctacatagtaatgtctcaagtttgtagcatctttaaaacataataggaggtgcaattcacagcagagtaataaccatcccactttaggcaatgtatttgtgattggtatgactttgttcccagagggcagttagcaacacaatattaaggctatgtgtacaaggaaaacaaattttaaaaatctcctttaaaaaaaaacagttcccgatcctaaccagtatcatgcacagaatccgtttccacctcttcatatggaagcagctctgggtggacatctagaaagttggataactatttatcacatatgatctgtaaagggagagatttacaagaaagtgttaaatttaatccataggaaagcaaaatcaaaaatcaatgaattttccatttgtagttttccctaggggctccactctctagatggcttaaatgcgttagaattaaatgactaggcacaattgtttgttagtgacataaaagcaaggtaagcatttctgctttatgagtccaagcacagggacacttggttttctttggaaggatatcataaaggcaatgtttatgagtaatccctcattgtctttccttctgtagcattcaatggtatgtactataatttagaaatgaaaactacttaaagaccacttgctaagtttcatgtatttcaaattctcagatcctgagtgtttaaatatgcctatatttcttcatgaaaaaaacataatctttgccaagttagaaaaagaaagtcatattcccatttttaactcaatgtaatcagaaatttggacagtttatagccttcaatacattatgtaatttaggtaacaggctgaataaaagtaaggaacctcagttaaattcagagagaagctagtaattatttctaagactcaaatgtatagaacagatctctgatattaaggataagaccctcaaggtgacccaaaatgtgtaattgtgggattattttgggaggaatcaccatagattcttactgctataaatacagtcaaatgtcagataaatatactccactgaaatgttttctaggaatgatgttggaaccaatgttggtaactttgaaagtcatggagaggatttcagatgatagaagtcgggcaactatcccaggtttaataaataagcaaatggtgagttccaaaaatgctgtatcaatgagcctcatattgatcctgagcacaatttcaggaaggtccattaaatgggtctttggagagcacttaggataaaaggctggcagcagggattcactaagagcaatggtgccaagcttgcctctttgacattgttatctgactgataaaggtaggctatagcggtacacaatacagatatttccagggtaaagctgttgagctgctgtaattttccttgcctcttcactatcttctcctatagttgactcccaaggaaaagatagttgacctttaatctagaaatgtatgttaattggaaaaacaaacaaatgaaaccaaaaactatcctttaggcttctctctgctcagttattagatcatatgaatgtgcccttaggaaacacagaaggcccacactattatagagacaaatttcttacattctctgctgtttaatgctcttcaaaagacttaccatacttcgctaatttgattaccaactacttgaacacagggaccaatgtgcttattaaaaattttgcatattatgagggcattaacttttaagtattcgattgttaagacaatgcatattattataaaccatagaaggcacacttattacctccttaagaaccagtctctatttctctggttcatagaactccaaggtcataaagggattggacatttgtgtcttcaattggccctcttcagccctaggataaatagtgattaatctaagccaatggttttcggctctgtctgacccaatgcctctacttcataagaaattcttcaaagaccccttcactattctaaactattagtgagaacacaatgtatgcattcaagttgttgaaaatattaatgttatgctgaagctaacaaaggagaaataatttactgtcaatatatgatccaaaatgtatataattgtgccagaacatttacatatcaaataaaatagaacataatgaaattttcatatcttcgcccataccttgaaacattgtaaataaaaagctacaaatatagtttcattgaataaccaaatgccaaaactgccatttctgtttttgacatgattgatctgcattggtaaatgtaatagatactttctgtttggcccttgtcccctgttatactcccctatttactggcttttgtccaagtggaatggtccatattgaatatctcaatctgttcccttgctcattgccttctatgcatgttcatgagattaaagggaaggaggaaatgggattgggggttattgcctaaactccctctctgctaggtctccttgaccaatctttttcataagaaaattagtgtttccttgcatgatcagggaagtttactccccagaactctgcctgctgctactaacccagagttattgtggggtgtgatttctgtgattccttcacccttctccgctgacattttcgtaagtagtctctttggaaataaacccatgttaaattatcttagtttgtgtgtgttctatttttcctattgagactctgaaatgagtatctaaatgaaaaaatctaccatcttttctcatatacatagtagtttcattcttgcaaaattcatggcatattaaaaccatgcaaaagtacttggcacttaggcagttacatttgggattgtataattaaacaaagcaggttattcaccttcattacattagaaagtcattcaggacatacagcaatccttaattaggaacggctatcccatgttactggacatatggcatccctgttttccaatccttaaagtttttccttaaagttccaaaatgccgtcacttattatttcctgccattggattttgtcacatgaagttgtaaggctgggaatgccatagccatcttgaaaacataggtagaaagataagagaatcacaaagtggatcatgttgaattaagtaagcattgataccatctatttgttgtgcgatttggtaaaagttgctccttgtttttttctttaattagttgactattctgttacttgaagctgaaaactttttttcttttctttccttctttttttttttttttttttgacagaatcttactcagttgcccaggctggagtgcagtggcatgatcttggctcactgcaacctctgcttgcctagttcaagcaattctcacacctcagcctccctagtagctgggattacaggcacatgccaccacactcagatgatttttgtatttttagtagagatggggtttcaccctgtttgccaggttggtctcaaactcctgacctcaagcgatctgcccacctcagcctaccaaagtgctgggattacaggtgtaagccactgaccctgcccaaaaacattttaaccaatagcaaagcacattatttcattacattttttcaaaagttgccagtaatttcaattaaaaatatatataacatgtttaatgcaatacaaatgcttttcaatgtacaatggggttaagtcttgataagctgattataaattgaaaatacagtaagttaaaaatgtatttaatacctaacttactgaatatcacagcttagcctggcatacctttaatgtgctcagaacacttacatcagctgacaattgggcaaaatcattgaatacaaaacccactttataataaagttttggatattttatgtaatttgttgaatattgtactgaaagtgaaaagcagaatggttatattctattcaaagctatcacttttgcttcatcataaagtaaataaatcataaattgaaccattataatttgttgaccatctgtgtatatgtatgtgtgtgtgtacctatataaacatgtatgtttatatatatatttgtgtgtgtatatatcctcggtgtgtgggtatgtatgtttgagagtgtgtgtgtgtgtgtgtatgaaattgtaggaaagtaaaatttcttatcttatagatatagcatgttaacatgttggtacctatcttcctgagatgtaaaattttacatggatagatgtgtacatttactgttgtacacaaagagaaacatattctgtaggctctttgtttttctgtaatttcattcaacactatgtggtttatatggatgattacatatataatgctaggatgaaggttcttctctataactttgaaacttccttgattatcaacccttggtatattcttagaataggattttattttagaattaagatccttgtttcaggactctagactgttaacacacagagtcaataattattcagaatggttgggttagttcacattcccacagatgagacatcaaatgtccaggctgcacagcctcattaacactagattttctggacattttatgtagtatttcatctgatataaaaagtagaattctaatttaattatggttgctaatttatttttatctttttagtcattatgaaaatgtttaactatatgaaaagctaggaaagagttttattttttaaggtagtacttcagaaatatttgtgatacttaatttttaaaaattaactctaaaaaatcttgaaatgtctgtttaatgaaataggacataaatgctggtcacattagtgaaaaatatttgtttaaaattaaaatatctgtatcaatcctgtagatattaataatttttaaagaatgacatctttaaaatataaatgttctaaacttataatcagttaaatatgtctctattaatacatatagatacatatacctaaataaatttgaagacttcaaattccaggtacaatataattcttttctatcctgtgatttgtcattcagtattttgtaatttgaacagaaatattttgccctaaccacatgtctgtattttctcttacctagaaatgttattttatgcaaaattgttttaaaggtcagtttgcatgtttgaaaacatcttgtagaatgttacataatatattgcatatttggttacattgttttaactgtgaaaatatggtttaaatctatgatgctctttagtgctgatcatgatgcaaagcaaatttatctgtataaaagtctcctgttaattttttttattattatattttaagttttagggtacatgtgcacaacgtgcaggtttgttagatatgtatacatgggccatgttggtgtgctgtacccattaactcgtcatttaacattaggtatatctcctaatgctatccttccccccttcccccaccccacaactgtccccagtgtgtgatgttccccttcctgcatccatgttttctcattgttcaattcccacctatgagtgagaacatgtggtgtttggtttttttccttgcaatagtttgctgagaatgatggtttctagcttcatccatgtccctacaagggacatgaactcaacattttttatggctgcatggtattccatgttttatatgtgccacgttttcttaatccaatgtatcattgttggacatttgtgttggctccaagtctttgctattgtgaatagtgccacaataaacatacatgtgcttgtgtctttatagcagcatgattttaatcctttgggtatatacccagcaatgggatggctgggtcaaatggtatttctagttctagatccctgaggaatcaccacaccgagttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatatgcatttctctgatggccagtgatgatgagcattttttcatgtgtcttttggctgcaaaatgtcttcttttgagaagtgtctgttcatttcctttgcccacattttgatggggttgtttgtttttttcttgtgaatttgtttgagttcattgtagattctggatattagccctttgtcagataaggaggtcgcaaaacttttctcccatactgtaggtggcctgttcactctgatggtggtttcttttgctgtgcagaacctccttagtttaattagatcccatttgtcaattttggcttttgttgccattgcttttggtgttttagacatgaagtctctgcccatgcctatgtcctgaatggtattgcctggtttttcttctagggtttttatggttttaggtctaacaagtaagtctttaatccatcgtgaattaatttctgtataaggtgtaaggaagggatccagtttcagctttctacatatggctagccagttttcccagcaccatttattaaatagggtatcctttccctagttcttgtttttgtcaggtttgtcaaagatcagatagttgtagatatgtggcattatttttgagggctctgtcctgttccattcgtctatatctctgttttggtactagtactatgctgttttggttactgtagccttgtagtatagtttgaagtcaggtaacatgatgcctccacctttgttcttttggcttaggattgacttggcaatgtgggctctttttggttccatatgaactttaaagtagtttttttccaattctgtgaagaaagtcattggtagcttgatggagatggaattgaatctataaattaccttgggcagtatggccattttcacgatattgattcttcctacccatgagcatggcatgttcttccatttgtttgtatccttttttatttcattaagcagttgtttgtagttctccttgaagagatccttcacttcccttgtaagtggtattcctaggtattttattttctttgaagcaattgtgaatgggagttcactcatgatttggctccctgtttgtctgttattggtgtataagaatgcttgtgatttttgcacattgattttgtatcctgagacattgctgaagttgcttattagcttaaggagattttgggctgagacgatggggttttccacatacacagtcatgtcatctgcaaacagggacaatttgacttcctcttttcctaattgaatgccctttatttccttctccttcctgattgccctggccagaacttccaacactatgttgaataggagtggtgagagagggcatccctatcttgtgccagttttcaaagggaatgcttccagtttttgcccattcagtatgatattggctgtgggtttgtcatagatagctcttattattttgagatacatcctatcaatccctaatttattgagagtttttagcatgaaggtttgctgaattttgtcaaaggccttttctgcatctattgagataatcatgtgttttttgtctttggtcctgtttatacgctggattacattgaccgattttcatatgttgaaccagccttgcatcccagggatgaaacccgcttgatcatggtggataagcttttttatgtgttgctggatttggtttgccagtattttattgaggatttttgcatcaatgttcatcaaggatattggtttaaaattctcctttttttgttttgtctctgccaggctttggtatcaggatgatgctggcctcataaaatgagttagggaggattccttctttttctattgattggaatagtttcagaaggaattgtaccagttcctccttgtaccactggtagaattcggctttgaatccatctggtcctggactttttttggttggtaagctattaattattgcctcaatttcagagagtgttatttgtctattcagaggttcaacttcttcctggtttagtcttgggagagtatatgtgtcaaggaatttatccatttcttctagattttctagtttatttgtgtagaggtgttaatagtattctctgattgtagtttgtatttctgtggaattggtggtgatatcccctttgtcaatttttattgcatctatttgattcttctctcttttcttctttattggtcttgctagtggtctgtcaattttgttgatcttttcaaaaaacagcttctgtattcattgattttttgaagggttttttgtgtctctatttccttcagttctgctctgatcttagttacttcttgccttctgctagcttttgaatgtgtttgctcttgcttctctagttctttttattgtgatgttaagatgtcaattttatttctttcctgctttctcttgtgggcatttagtgctgtaaatttccctcttcacactgctttgaatgtgtcccagaggttccggtatgttgtgtctttgttcttgttggtttcaaagaacatctttatttctgccttcatttccttatgtacctagtagtcattcaggagcaggttgttcagtttccatgtagttgagtggtttcgagtgagtttcttaatcctgagttgtagtttgattgcactgtggtctgagagacagtttattatactttctgttcttttacattttctgaggagtgctttacttccaagtatgtggtcaattttggaataggtgtggtgtggtgctgaaaagaatacatattccattgatttgggatagagagttctgtagatgtctattaggcctgcttggtgcagagctgagttcaattcctgtatatccttgttaactttctgtctcgttgatctgtctaatgttgacagtggggtgttaaagtctcccattattattttgtgggcgtctaagtcactttggagatcactaaggacttgctttatgaatctgggtgcttctgtattgtgtgcatatatatttaggatagttagttcttgttgaattgatccctttaccattatgtaatggccttctttgtctcttttgatctttggtggtttaaagtctgttttatcagagactaggattgcaacccctgcctttttttgttttccatttgcttggtagatcttcctccatccctttattttgagcctatgtgtgtctctgcaggtgagaagggtttcctgaatacagcacactgatgggtcttgactctttatccaatttgccagtctgtgccttttaattggagcatttaacccatttacatttaagcttagtattgttatgtgtgaatttgatcctgtcattatgatgttagctggttattttcctcgttagttgatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtggagtatattatttctccttcacttatgaagcctagtttagctgaatatgaaattctgggttgaaaattcttttctttaagaatgttgaatattggcccccactctcttctggcttgtagagtttctgaggagagatcagcagattgtctgatgggcttccttttgtgggtaacctgacctttctcttggcagcctttaaaattttttcattcatttcaactttggtgaatctgacaattatgtgtcttggagttgttcttctcgaggagtatctttgtggcattctctgtatttcctgaatttgtatgttggcctgccttactagattggggaagttctcctggataatatcctgcagagtgttttccaacttggttccattctccccgtcactttcaggtacaccaattagacatacatttggtcttttcacatagtcccatatttcttggaggctttgttcatttcttctattccttttcctctaaacttctcttcatgctttatttcattcatttcgttttccatcgctgatactctttcttccagttgatcacatcggttactgaggcttatgcatttgtcatgtagttcttgtgccatggttttcagctccatcaggtcctttaaggacttctctgcatttgttattctagttatccattcgtctaattttttttcaaagtttttaacttctttgccactggttcgaacttcctcctttagctcggagtactttgatcttctgaagcctttctctctcaactcgtcaaagtcatactccgtccagctttgttccattgctggtgaggagctgcattcctttgcaggaggagaggcactctgatttttagagtttccaggttttctactctgttttttcccatctttgtggttttatcttcctttggtccttgatgatggtgacatacagatggggttttggtgtggatgtcctttctgtttgttagttttccttctaacagtcagggccctcagctgcaggtctgttggagtttactggaggtctactccagacactatttgcctgggtatcagcagcggtggctgcagaacagtggatattggtgaactgcaaatgctgctgcctgatcgttcctctgaaagttttgactcagaggggtacccgggcatgtgagatgtcagtctgcctctactggggggtgcctcccagttaggctactcaggggtcaggaacccacttgaggaggctgtctgcccgttctcagatctcaagctgcatgctgggagaaccattactctcttcaaagctgtcagacagggatatttaagtctgcagagggtattgctgtcttttgtttgtctgtgtcctgcccccagaggtggagcctacagaggcaggctggcctccttgagctgtgttaggctccacccagttcgaacttcctggctgctttgtttacttactcaagcctgagcaatggcgggcgcccctcccccagccccactgtaaccttgcagtttgatctcagactgctgtgctagcaaacagcgaggctccgtgggtgtaggatcctccaagccaggtgctggatacaatctcctggtgtgccatttgataagcctgttggaaaagcgcagtattagggtgggagtgacctgattttccaggtgccatctgtcacccctttctttgactaggaaagggaattctctgacccattctgcttcccaggtgaggtgatgcctttccctgctttggctcatgcatggtgcgctgcacccactgtccagcactccccagtgagatgaacctggtacctcagttggaaatgcagatatcacctgtcttctgcatcactcacgctggcagctgtagactggagctgttcctattcggccatgttgcctccatcctctaatttttaactttcaactgattagatacatttaccctcttctgaattttaattcctgatgaaaagattgtgaaatctcaagaggataatgaatcagcttctgattatattctggaattacgatttgatcacccatccaagaatgcgtattcactttcctttacattacacacatgcataataccatgctgagtgatgctggaaaaagtgagtcttcagtaatgccctcatgaaattacagtctcactacaccgaggtattttctttttaacacatttttcttttctgctgtgaatatgtgccttctaagaggtgaacaactgggaaaaactgaaaaagaaccttcatctaattcagtaactagcttttgtatcttctaagaatttttatctccagaaagctctaatcttcattcctttacaagctttatttctctctcctttccaacaccagacttttctctgtttgttttctataacttttttagagatgcctacaatagaaaaacactatgacatattcaatacatctgaaaagtttgcattgccatagataagaataaattatctgtttataaagaaaaaaacaataaaaatatgaaccaagaaagcacagaaggtagtaaccacatttacatgtttatcatggaatcatctttataatccatctgttacaattccacagagcaaattacaagtaattgtgaagtttcccctcattttataggtttggtcttataaggcatacaacacaaattttaattacttttctttttggtatttggatcttaatttggtgaagtggccactgggtagatgatggagcctcttgagacatacagtcttcttctagctttgttgatgtaaatattactgtgtagttttcattcacttattattttacaaggcatgcttcattaaaaacatgtcagcatctcattgacaaatcacaaaatttaaaaggcacaagaaaaaaacaatttatttgaaacattcctgtgtaaaagtagtcaccactcttactattcttcaaatatttttattatatttaaacacaagcctagttttatcttgagtgtctcaccttgatgatattgtacactttaaacttagaaaaacttgaactctattggaaatttcctacagatcagcttttctagatgccaagcgccttgtttcagctgtggtgatgacagcaaattgggttctcagggattctggcctctggcatcatctcagttgtttataattgaagttggctctgatgagaactcagcttagatgcatggttgtactgctgggcttaaggctggcctgccagcaggttgcattgaggtgtaactaggcaaagaaagaaggagtttattgaggcactactgacaatagcaaagacttggaaccaacccaaatgtccaacaatgatagactggattaagaaaatgtggcacatatacaccatggaatactatgcagccataaaaatgatgagttcatgtcctttgtagggacaaggatgaagctggaaaccatcattctcagcaaactatcacaaggacaaaaaaacaaacaccacatgttctcactcataggtgggaattaaacaatgagtacacatggacacagaaaggggaacatcacacaccgggacctgttgtggggtgacgggctaggggaggaaaagcattaggggatatacctaatgtaaatgacgagttaatgggtgcaacacaccaacatgtcacatgtatacatatgtaatgaacctgcacgttgtgcacatgtaccctagaacttaaagtagaataaaaagaaaagaagaaggttgggcaaaattaccaacaatcttcaactatgaatttttatgagtaggggcttcccacaccatcaggcactccaagttggagaaacaagggatgttgaattgaaagtttaattttttaggcttgatagtcagattagggaagttttgggtacacctttcccactctagagccctctccctaactcacggccaatttgggacatgggctcaatggaaaagagtgccgagatcaattagaaatatccttcatgaacataggaggcaggcattctggccaaggggtgcgtcttcccactttgtaatccagagtgcgatttcttcttgctatctgtccctccgtaaataagcgttgggtgaaggacaaggtagttacaactgaggatggaatgagattctagcagaattgcaaaatgaactgagagccacgaaagtgttcctctgtgaaccagcagagagatctgtggaaggcaaaggaagaggagccaagaggccagataacattcctgcttcccctacattgtgagagtgaaattatcagcaacgtatatcagtaactaaccagaggctttttggagagtaagacttctgatagatacctcaatagctgaagttgctcttcagtactgcacataacctgtggacagattttcatcattattaattcatttattcaacagatagatattaaattcaaggcatagttctaaactatgcagtcaattacaaaaaaataatgaagggcattagctgtgcctcataggacgttaaaactctaggtgctgaatgagacaaatagggttcccacatcaagtgcctgggctcctgttataacctggactgtgcttccaatgacttctcttgtttctgttttggtaaacccatcatttggcttagtccctatccttgccatgctcacccaccagtaggtggacctccttgaccataactacaggtatagatctttgagtttcttttcaaatgtttgcttactttagagctgcagtcaaatgttgtttggaccataagactctgaggatgtgtgtggttgaaactgtcttgagactcaaagagctattgaggaagggatttggtagctgaacttttttgaagtttttctctgtctctcacaatctgggtctgaatagcttaatatattgtttaatttctacatcaatgatagtttaataggcattcatgaaaatcagttctgctgggagtttattatcctactccaatagcaagtaacgcattccttaaatttaatgtatgtataaattctacatggtaagtgaagctgtctttatgaattgctgctatagaatatactagattgtgtaggttttagtacaatccaggtaattatcaagcctttgtaatattttcaggaaagtgatcctttcacttcagtttatggaacttggaaagttttcggttgccacccacttgttagatcataaacttaattatatttgtctgaatttatttttctatttataaatttatctggatgttttctcaaaggtttcccagattaaaaacctatggctttgtaaaattaaaacagaagtaataagaattgtgttaaaaaacagaatcaggccaagcatggtggcttatgcctgtaatgccaacacttagggaggccgaggcgggaggatcatttgaggtcaggagttcaagaccagcctgggcaacatggcaaaacgccacctgtattaaaaaaaatacacaaattagctggcgtggtggtgaatgcctttattcctagctactcaggaggctaaggcaggagaatagcttgaacccaggaggctgaggttgcagtgagtcaagatagagccactgcattccagcctgggtgagagagtgagatcctgtattaaaaaaaaaaagaacaaaagaaaagaaaaataaagaaaactagaatcatacaatgagagagattgtatagcccttttaattgtccataatggatacatttctttttctgtgtaatagtttatcagcatgaaaattttctttttcttcgtaatagtttatcagcatgaaaaacaaagagtcactgaacactgataattttttttctctctctctctcattttttcctttttttggagatgaagtctcactctgttgcccaggctggagtgcaatggcaacatctctgttcactgcaaccttcacatcctgggttcaggcgattttcctgcctcagcctcccaagtagctgggattccaggtgcatcccgccatgcctggataagtttttgtattttcagtagagacggggtttcatcatgttggccaggctggtctcaaactcctgacctcaaatgatctgcccgccttagcctcccaaattgctggtgatgattttcatttaatggtgttctacaaagtgagtttaggcaatgaaagcacacatgtcatctatagtttaccagaaagtagtaccggtcaccagcattgaagcatactcctaacactggaaaatttcttcagcagctagaattaatctcagatttcgagactggagcaaagacaaatttggtatgtgttcattcagattagtaaatctccatggtgtttgaactgtatattatcaaatctaaaataagtcaaaagagttgaacaatatctcatctctgagaaaaaaatgcattattttcaacagatttaagactgaatttaaaatccaactgcctattccagtgtatgtttctctagaataaggccaagccctacaaattctggatagtgtcttccaagttgtatttaagtgataattgataaatctatggtttagatacatatggaattccatataactctagctccagcctttgtgagtaaaaattggcagtgatcatggccttaatgggggcatgtggttaattggaattttcagtaccaaaagtcgtcttcttactagtttatcagggtaacctataatagtatccataactcattgcccacttgtctgttttgatttcttttttaaaaagacaattttaaacttagaggatttgtacctcaagtcacatatgtggcacatttataaaataatcatgcctttgcatatttttcctttgataacttagctatatatccaagccatttatgttttttaattgccacaaatattgcactgaaatagagcactagttgcaaaaatgcctggtgtaacatttcttcttgttcttgaaagttattttaataccccatgtttaagatattcctagacaactatatgtaactataattatttctgctaggtagaaacatctttgtggtcaacatttgtgaagtgccttgtaaataaaaatatgcttgagttgaaatagtattttgcaaatatagccctaaatagagctactgatttttaccaagaattaaagactccaaactctgtctttgtctttcaaattaggtttataggaacatctcattacaatgagccaaaagcctatctgatcattaatgagataattttgacacttccaaatgacacagttaatttgtagtaggtttttgaagtgcaaattgcatgtttctgtttaaataatgacagtaaaatatggacactatctattcacactctatatacacaactacaacttgtctctagaagaaaagtttaatttttcaggtctcatccacaaaatgaagtgttaataagctgtatctttattctcatttttaagtaatttcttcttaaccattgtataacactaccacagtttgtatggagataaaataactcatggtgagaaatccagttctttaaaaatcattttaccttcaatcaattttaggatatctatggttttagagtaaggacgaaaatttataaacatttgttaaattatgcaactgtttttgaagatgtttcaaaattacattttccttattttacaactagttttcatgtattcacaaatgagacacatgagaattattaatgcaaaagcacagcatatcaacaaagtttataatgtaaatagtttagttaggaaagaatgtaatgagtgaattatcaaagctattttattggttcctagatttaccatagaagaaaataaagcagccttataaaattttctcaacactgagtccatttaaggtctattttgtatgccgtaagttctaaaaaatgttattgccggtaaaaataggatgcctatctaaaattgtctttttaaatgttctctcttattcttcttcctttcctatgtgtgcacagaatactgtcatcgtcttgattggaacactgtctctctttctcagagggtatacatttgtagaagggagaaaatatttgttaattttgcttcctataagataaggtctcaatggttgaaggtcagttaacaaacattttttttgtcttcatactattatcttggaattaccaactggcttctatttagattttgaattatgaaagaaaagaactagcatttgttagaacttactgtgttccaggaactttattgataccatttcttctcattaccacatttgttctttcaattagtcttatttttttccatcttaataaggtgggaccagaggtttgtaatatccactaacccactgtggatttcatggcttgcaagaggaagaaagcatggtggaactcaggtttctctgattgcaaattcacatcctttcatgtctccatgaaaaatagaaaggataaattgggctctattctaacaagagaaacacaattttccgacagttaaatgaataattcttaaacctcaaaaataaaacgtagcaaaacctcaattcaagagtagacataaaggttgtggcatgggtagaagggacttatgtctagtgacatagatttgctatgcatatctgaccaaaaatctccctcatgattttcaaatcagatgtataactgcatttaatgagtttcacgaatcattaatatcaggctctgaaaacaggatcattaaaaatgattaagattttcaacaacaaagattttatctaaatagtaaggaaattatattagatggctccattccctgggcagtctagttaataattcaacttgttcaaagctataaaatatggcaacttaaaaaattatgaaagtttttctaacttattcttaaggtagttggccattcttcctcttgggaataagaagggcagattttctgtcgaagcattttgctattgcttttcaatttccatttatggaaaatagataaaatatcaattttttagttttaaatttaaagtcaaaatggagataattaagtatctcaattaactaaatattaatttttcaaaaaatagcatttactaaattctaatcaatcaattgactatttttatccctggctcaatgtaactctctttgacatactcttgtcttaattctagtttatgtcaacaatgtgtaatcatagatgactctttgccattttggtctctcagttctattaacacctttgatctaacgataatgttttccaacagaattatttctactcaaacttctgagatgaaatttgttggtttagtctcaccccaatcaatttttcaactctcaggacaccaaatggtgtcctacaattcaattcaatcctgagactatctatctggagatagaatcagatcccacaagttcagggttcaggaccacaagactgccacccccccaccattagagaggagttgtgggcctgccatactcctgaccaactggctataaattaggacttccatggattccttccccaggttctataatttgctaagatggctcacagaacccaagaaagcactttgcttacagttactgtctgatacaaatcaggaactgtcaaatagaagagacacatagggccaggtatggtgaaaaggggcacaaagctaccatatgacctctaagtatatcattgtatcaccctcccagcacctcagaggtgatggaggagagggctgacagttttaaccatctagttatgccttcatgtttctggtgtcaagcacccaccctgaagccatacgggtctccagccaccactcatgtcatgtcaatagcataaactcaggtatggctaagagggacttatgactagtaaaggatggtcctctcatctctatcaggaaatttcaagtttcaggagctctgtactgtgaaccggggaggaagaccaaataagacatacactagaccagttgtgctaactactgtgtgcctcaaaattgcctacagttgtgttacaataagagattgctgagacctgctattggaatttcatatttggaagatctgggggtgtaacctgagaatatgcagttctagtaagttcccaggtgatgctgttgctgctagcacagggaccacacttccagagggactgagtgaagcatcgtcgttacttataatagcaactcctctgtagtcacaatttcattcatcccattctctgaactcctcctttaatcattccctttcatacgctgacataaaatttttcaatctctctgagacctccaaactattattttatcatatttataatgacccttacctactgatgtactctatttcctgttctcctgcctaaattccgtggccaaccattcccaggaaacttcaacttccttgtttctctttcactttgctgaatctaaccaggaaaataaccctggttagatccaaatttccaccaaatccccacatatattttagcaactagctatatggatcaaattgaaaaatatcccacttgaaactgagaatctgagtgccgcctatcaatcaatcatactacatatgttccaatctattcactctctaattttcctagttttgtatcttatcctgtctctaatccctaacacttccccagaaatcctcaatgtctttttgggtgtgcttccctgagaacattgaatcacccaaagacaatttccacagactcctgaaaccatttaaactcacttttccatgcctacacccacatactctccattttcacctattattatctgtgaaataactggcccctatctgtatattgtctgatgatgatttctatattacaggtgaagaaaatgagaatagggttagagctactttctcattatagcatagcttagaatcaaatccacgcagtccaccactgaaactggggttccaagtcagtgtatttggagaaggagagctagtagaaaaacaaggatgaaaacatcaggatgaagtttctgatggaagaaaaggacatttttactattatgaactccttgaagtagaccttaagcattctcttctagacaaacatccattcatccactccagtgagctgattaagttttaggattttaagggtcagtgaacaattattactcattcagcaattaaagaaggattaacatgaatattatattggagaagtttcatttaaaacatatttgattgatttttggcaattgtcttctatcagatcattaccaatccatatgagttggtaggaagggagaaaacccaaaacttaaccagatgcctgaagttagggaatattttataaccaacccagggggaaaaatgctcaaaaggggaaagatgaggacagaaaacacatttcaaagattttaactttttgacaaaatgtcaattctgtgcaagaaaaactgattgtgtgaatataactttgtcatttacatctgccaatgtgttcagaaatatttaatttataagttttattaatagtagtttgttaacacaaaatttattcatcaaagtatctaaaacattctaaaaatactaaaaattttcaatttaaagattaagctaaacagctctgtatatataagtaagctcaaacaaacgtgcatgctccccaacaataacactgctacagatattgactggtggttttggtttcatttcattttataatggcaaatctggttaagacccagattctgggctgggcgcagtggctcacgtctgtgatcccagcactttgggaggctgaggcaggcaaatcacaaggtcaacagatccggaccatcctggccaacatggtgaaaccccatctctactaaaaaaacatacaaaaattagctgggtatggtggcacgtgcctgtagttccagctacttgggaggctgaggcaggagaatcgcttggacctgggaggcagagattgcagtgagcagagactgtgccactgtactccagcctggtgacagagagagactacatctcaaaacaaaacaaaatcccagattctgaattgaatctcacaataaggatctcaattgactcaaagaaaataaaatacctagaaatccaacttacaagggatgtgaaggacctcttcaaggagaactacaaaccactgctcaatgaaataaaagaagatacaaacaaatgtaagaaccttccatgctcatgggtaggaagaatcaatattgtaaaaatggccatactgaccaaggtaatttatagattgaatgccatccccatcaagctaccaatgactttcttcacagaattggaaaaaactactttaaagttcatatggaaccaaaaaagagcctgcattgccaagtcaatcctaagccaaaagaacaaagctggaggtacgacgctacctgacttcaaactatactacaaggctacagtgaccaaaagagcatggtacttataccaaaagagagatagaggccaatggaatggaacagaggcctcagaaataatgccgcatatctacaactatctgatctttgagaaacctgacaaaaacaagaactagggaaaggattccctatttaataaatggtgctgggaaaactggcaagccatatgtagaaagctgaaactggatcccttccttacaccttatacaaaaattaattcaagatggattaaagacttacatgttagacctaaaatcataaaaaccatagaaaaaaactaggcaataccattcagggcataggcatgggcaaggacttcatgtctaaaacaccaagagcaatggcaacaaaagccaaaattgacaaatgggatctaattaaactaaagagcttctgcacagcaaaagaaaccaccatcagagtgaacaggcaacatacagaatgggagaaaagtttcacaacctactcatctgacaaagggctaatatccagaatctacaatgaactcaaacaaatttacaagaaaaaaacaaccccatcaaaaagtgggcgaaggatatgaacagacacttctaaaaagaagacatttatgcagccaaaaaacacatgaaaaaatgctatcactgcccatcagagaaaagcaaatcaaaaccacaatgagataccatctcacaccagttagaatggcaatcattaaaaagtcaggaaacaacaggtgctggagaggatgtggagaaataggaaaacttttacactgttgatgggactgtgaactatttcaaccattgtggaagtcggtgtggtgattcctcagggatctagaactagaaataccatttgacccagccatcccattactgggtatgtacccaaaggattataagtcatgctgctctaaagacacatgcacacgtatgttattgtggcactattcacaatagcaaagacttggaaccaacccaaatgtccaacgatgatagactggattaagaaaatgtggcacatatacaccatgcaatactatgaagccataaaaatgatgagtttatgtcctttgtagggacatggatgaagctggaaaccatcattctcagtaaactatcgcaaagatgaaaagccaaacaccgcatgttctcactcataggtgggaattgaacaatgagaacacatggacacaggaaggggaacatcacacactgggaactgttgtggggtggggggaggggggagggatagcattaggagatacacctaatgtaaatgacgagttaatgggtgcagcacaccaacatggcacatgtatacatatgtaacgaacctgcacgttgtgcatatgtaccctaaaacttaaagtataataataataatttaaaaaagaaatgaaaacacacacacaaaaaaaaaacaaacacacacacaaaaaaaagaaaaaaataaggttctcaaagaggtcattatgtatataatctattcttaaaaaaattttctccaattgtttattgaaatatcacacaggctctgactttgtttatacccttaagaagtacgtagatttatgtgtagcttttgtaaagtgaaaactcagaatgtctactctgttctggtaccactttagtttaattgttggaaaatatttaataaaaatgaattactcaacaaatggaaaatttgaactttgcatactaaatttttacttcatattatcaactcttgaaaaataagtgtgtctattagaaatgacactcatttgactataccataatgtatttcagactttttgtcttcagctacagaatttctctgtcttttgaattatgttagcgggctttatttggccagtatttgtgatccacctccactaattcgcaactctattatcttacccccagggatgcatttccatagttctgccttgttatgagtgtcatttttttcttctgttttgttgactgccattcaagtagttttggctttatcagagattttcactttattgtttatcacctcctcattttttttagcttctcataatttactgtattatatctacctgggcttttggttcctttacaggtttgtttcattttatttttagcttatgatacttctaaagtctgtacccttttaattttcacttgcttcatcgtcacattcttgtgttttgtttttatttcaaaataccagaaagtaggatgtctcagcatcttggtgagtggaatagtttatttataatccaaaaaacccccatactttttgtgagctatctgcttctgagtaaaaattttatataaaaattcttgaaaaaaaatcttaaacttctgaaggattgaatgagattttaaaaatcattctatacaacaggtgcaaaatttttattcctctactcaagagaaataatgaacatttgttattcatttactaacatctaaatgttaatgtattcaattatacattattaaaacacgattaagcttaagaggtggaaaagtataaaacaaacaagtgtataatttacctttattaatatgaaacatctttttctctcctgaaaataaagattaaccagtggtgtgctgaggcgggaggtggtgtgttggagggagaaaagccatgatttgccaatttcagcacaaaactgaaaatggttattaatctttactagccccagatatcttttaacatatattgaaatctatgacccttaaaaagaaaacatatatatagattttgacaaaactttgcagttccactcatggatccctgtgtaagaatcgtttttctatgtgtgtttgcaatttaaagagttcagactttatgattcacaggtgacaactcatgatttaatctgaacacttaggcttttataatttgggagtcaggtgtttaactgctgtagtagtgactgcttcttctcagagaaacttagtagctaagaccaggaaaatgtcccttggtgtgcaacacacctcttctttctgaacgtaccatataagacgctaactttgtctcaaagtttatatgacttttgcatttgcattactagctattttcttttggaactgtaggacttggagacctttccctctaccctctgaaggtatgataactgagtctattgaataaatggataacaggcatgtcaaaagaagaaaatgtgtacacatttattacacgcatgggggaatcacaggaaagaaacgtggaatcaaaaacaaaacaaaacaaaacaaacaaaacaccaccaagaaaaaaacccagtgagatttaggagcttgtagggaaggcaggaggaagaatgtaggaaacttaagggagagcaaatgacttttgggaaagatgaccagacccctaggagcatagatgatagtttgtggcagtctgccttggtgtggaatggactcttagtcttgtctcctgtgatatgaggagtcaattttccctggctgatgaaactcctaggaaggagatgaatgtctttgtgctgacaagacagtatcttgaagctttgttttccaattcagttctaaatctgcagtgtataaaaatctcctcatcatgctttggatgttatggtagataaatggtatctttacaaagatacattcattctggtattgaaaattccttttggaggatctctcttgaggaacgtaaagggagtgcagagaaagcatgtcccacagttgttatttttcaaatattttcagttcaatgtaatcagtacaccaaagcaatacatttaggactggcatttcctgaacaccttcagaactctttttatcccatgttatttctatgagatcacgtgatttaagaacaacttttacttgccacttacatatatattgaaaaggcaaactttcctttcatagtttgctaattttggcaaagtactttaacaaaagttaaattaagtgagtaagtgaaattttctgttctattgttttgaaaagaattctagaaactgtccttgtaagaacagcaaaaagagaaaaagataattctcaactgcagcttcaaccactctttgcgtaacaatgtatctaattaaaaggcaaaactctctatttcaggtttatatgtatcaattgcttgattagaaagtaaattatttaccccatataatctggtgtcaaaaaacttataacaaaattactttgattttattgcttataagtttgtgaatttaaatctcaactgacagtgatgaatttatttgctttgtgctgacaagacagtatgttgaagttttgttttccaactcagttctaaatctgcagtgtatcaaaatctcctcattatgctttggatgttatggtacataaatggtatcttcacaaagatatattcattctggtactgaaagtgcatacttaaaattcttcatgaacagttttattgaaaaaatatgtagacaagccattaattatacacagtgatctggaacaaattcttacaagaagcctagcatgtcttccattaactgtatacaatttataaaaagttattgaaagtcttcctgaggttaaacaataaatcttttaaatttaatcactgtgctccctcaaaggtagttttttctttatgacactcaggggatacagtcagatctcagcctactttaaacaactaggcagtatttttagtgcacttttctgtttgttaaaaagctagttgtcaaaaataagttgctcaattgtcttcctcaattactttttattttgttttgtaattattattctattttggttttcctttagaattgtggactatcttgaatcagaaattgcagagaatatataaataagtaagaatgcactcttcaatcaaactagatctcgaaagtgttttgttgtagtttataccttgaattcgaaggccattctatacaagacacttgaaaaattttcaagctcttatatttcataatagtacagaatttattgttcttttatttgcaaggagatagaccagataaaatatcactttattttttacagtgttgactttgatattctaaacttgtcagtttatacagattaatgaagactccatacatgtaaaattcactataatttttttctagtatgacagtccaaacaaatagtaactacatacccaaacaggtaaagtaaaaatatacaatagcttgacaaaaaaaaaaagaagaaaaaagatacccctatacattccttaacattctaaaactatgaggaccaaattggattcaaaagaaacatttctggtgggcagggaaagggctaaaaagctaaagtatataataagtaaattcctcattgctgtaacatatatgaccagcatgacatttcaatacatgttcaagttttctgaaaaaacttctaggataataggatttcaacttttgattctacagatatcattcttgtgattggtatggtagaatcatcctcttcatgtattagaggattcaaatgaaaaaaaatcaggcagctaattcctttccaggaagccttagagattgttgtacataaaaatatgaaccatatttctgattcaaattttaattagagaattctctttattccctcttctgcataaaattatgcacttgctctctgctctccagacaagtaaaacttcttacctgatataatttgagataatcaagactcagaacatattatctcctagctgaaagtcccaataaacttctcaggacaaaaacagcaaaaaggtaaatatgcagagatagagtataaaacagtggttactaggggctgggggtgagaagagaaaatggagatagagaattcgaaggatgcaaagttgcagatatgtagaattaacaaattgagggctctaatgtacaacatgaggactgtaggtattaatatttattgtatatggcatttaactaaaagggtagtttgtaggtactctttcctcacacacatatccaaaagaaaggtaactgagattttcaaagggaatgctttcaggttttgcccattcagtatgatattggctgcgggtttgtcataaatagctcttaatattttgagatacgtcccatcaatatctaatttattgagagtttttagcatgaaggttgttgaattttgtcaaagggcttttctgcatctattgagataatcgtggtttttgacgttggttctgtttatatgatggattacgtttactgatttgcgtatgttgtaccagccttgcatcccagggatgaaacccatttgatcatggtggataagctttttgatttgctgctggattcggcttgctagtattttattgaggatttttgcactccactccactccattctattccattccattccattccatctcatttcattccattcccttccactctactccactccattccactctactccagtccactacactccattccatttcattccaatccattctattacattattttatttcttcaggaactcactctgtcatccaggctgtagtgaagtggcacaatctcagcccacatttcatttcaccgtgccattccattccattccattccattccattccattccactccactccactccactccacaccactccactccgctccactccactttactccactccactgcattcctttccattacatcccattccattcctctttattccactctactccactacactccactccactctaccccactccattccattccactctaatccgttccattcctttctttcgatagaatctcacttgtcacccaggatggagtgcagtggcacaatctcagctcacatttcatttcaccattctattcccttctattccattccattccattccattccactacactcctctccactccattccattctatttcaatccactcaactccactccactccattccatcacatcccattgcattccactccattccactccactccactccactccattccattccactccatcccatcccattccattacattacattccactccactccactccactccactgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagctgagaagaacaggcaaggacttaggaaatattccttatttgaaggggcctgaaagtgtggtctggggtacagcagtgacctgtcatacttgagaggattaaaatactctccaaacacagtcccattccttcaaccttagctcgttttttccagcgtctgagatatattaaacctagtccatccccaaatttagcattagattgcgaagttctattgattgtatttgatttgtaatttaagattttctccccctacgtaattttgttaaaaacacagaagtgaattctgttcacttaggtgtaacagttaatacttgctgtttaaggaactaattaaaccttactggcttataaaaaacaaccaccattttattggtttgaagttctacggatctgcattttggtgtggtggattcagctgggtagttgatatatgtgtgttgcctggatcataaaaaggccttagtcacctggtgccttgactgagcctggttggtttaagatagtttccttcacaatctggtggtttgtggtgactcttggctaggccctgtgtctccaacagggtagctccagacctcttcacaatttcccccaaaaagggaagaaccaatggatatttgcatcacattttccattgtccattcactggacaagtcagatggaaaagcccaatttattgtcagagcataatatgagggcttggatagaaggaaaggtgttattgggaaacatgagtagaatggtgtactgcaggaaatacatattatgtacatttttaaaaacataattgtaggccaaaattgctggtttgcaagaagcactttccatgatgttcaggtatagaaaagcaagatgtactgtcatgggaacactcttatgaagttgtttgtggaatctacatattaataggaaaatagctaatatagcccagtatatttctataacatttattttagtgaacttataatgtttctttgtattaaattattagattatatctttagataatattgttactaaattagtaggtaatatatatttttattcaaaaataaattgtgcatctaatgtctaccaattaatgtacttgtagatgtatcttatcttaacttgagtctttgctgcccctaatgaggcgtgaaggattcttctcccctggggaagtttttctttttcaggagggaggagggctttcccaggtaatgtgtctagagtgttgggcagaagaatctgggaccaaaccacaccagttctctccttaatccacgtcatttgccttctatcccagctatgtttccagtgtcctctgggtgtttccaagagcaacaagaaacgaataaatctctggtgagttgtttatttgttcttcactttgttttacactgtattttctgagtttatgggtgtctgtgaattaaaaaggaaaagtagaaataagtaaaactcaggttgaaggaaatatacataaataagataaagctgacctgtaaatataggcaggttataagagcttagagttgtctaagttgagtgcaaattttcctctgatctttctgatgccgagacaaaaaaggcagtcatgtttgttacgtgattagaatggaacccgagaagagagcatgctttgttcttgtgggacaggaaagcttgcgtgcaccaagtctgaaccaccaccttcattggtgacatagattatgtgctggaacatatttcacaccggcctggcagtaaacacttgtagtgttgtgcagtggaaacggtcatcttccgctaaagcacggcgtgttgtgcagtggaaatggtcatctgccgctaaagcacagcttccatcgtaatgtatgctccttgctcaaagagtgtggtcccaaacagcctttgggaggtcctgcttgattcatggatgaaacccggaacatcttgaggactgagttaaccaaaggtccttaaataactctccacactttttcttagtttgtctctacatgcaggatgtgcagcagcctgttcaaagtcatattttctgggaaatatttccagtgtttatttgcactttagcccactctgtgtagccttatttcttctaaactcaccattaacctgaataattgtcaaatttagggggactgtatttgccttactcgagtcttctaccatagttgaaactgtcctacccgagtgagttagagagaaatgccacgcattgagacgaattcaggagtcctttactagccagcgactgagacatggctaacgcacgaaattatctcggccccaaagaagggacaagattttcttttatactttggtttagagaggggaggggggattctagctgcagcaactttacagaagaaaaaaaacagacaaaaaacttagaaagacagatggttacaggaaaacaaactgttcctggtgtaggggctttaaattcaccacaaagtgataggtgagggggctctgggcattatctgccggacaaatgtgggggctttatgatactatctctgagtaaattgctgggaacgggggacatctcttgtctcagcactttatcagttaattgcacgctttgatatgttgaaaatcagcttgcacaagttaaagtccttgaggaaagggggtgggtaaggagcccttgatgtcttgttaatgaaggagccaaatggagtttgtctggttttctcagctaagggagagtctattcatattaaaaacaaggttagctgtctaaggaagagtctattcatgttaatacaaggttgggtattacaaaacgtctgttcatgatctggaaattcttctgtgttagttctgttaaaagaaaaactttaaaggagtttaatttagcaataaacgattcatgaatcggacagtccccagaatcacagcagattcacagagactccagtgcagtcatgtggtggaagaagatttatagacaaaagggaagtggcataccgaaatcggaagtggggtacagaaacaactcagcatttgccttgtttgaacacattttgaacatttggcagtgcctgagtggttgaagtttggccattgggattggccaagatgtagctgttgttccagtgcatactcttaagttagtttttcattcttgtatacctattaaggtaggttgcagttcatccacaaggactcatatatagaattatagagtccttctcaggccatacttagttcactttaacaatgccttccctttggttattttctcaattttgagagattggccaaaacttcagtcactggtgtcactattaccattgcaaatgtacttacttggtttagaaacccactgggaaatagaccagtgagatttgaaaaggtggaacaaggacttgagtagaaggtatcttcttatgctggaacatcctgtttacaggagaaaaacaaaacctggtttgttctaggatttatgtgtttccctaaagtcttagtttgattatgttacatttagcatgagtgactccattttggcttggtttggtttggtctgttgggacctattgcatgagcttagttcaaaacaatggcctcccataattttgcttaaaacattcctcctttttgctgggtgtggtggctcacacctgtaatcccagcactttgggaggctgaggtgggcagatcacgaggtcaggagattgagaccatccttgctaatacggtgaaaccccatctctactaaaaatacaaaaaattagccaagtgtggtggagggtgcctgtagtcccagctactcaggaggctgaggcaggagaatggcctgaatccgggaggcagagcttgcagtgagccgagatcatgccactgcactccactctgggggacagaccaaaactctgtctcagaaaaaaaaaatcctccttttcagtcaagttctcacttagttgagagtgtgaccaaaatgtagggccttagcatcactcttagttaccattgttttgggttccagttttagcatgtcattcccattgttttgggtttctggtttagcacttcactcccattgttttgggttccggttttagcacgtcactcccattgttttgggttccagtttagcacgtcactcccattgttttgggttctggtttagcacgtcactcccattgttttgggttccggttttagcacttcactcccattgttttgggtatctggttttagcatgacactcccattgttttgggtatctgattttagcacctcactcccattgttttgggttcccaggttttagcacgtcactcccattgttttgggtttctgttttatcatgtcactcccattgttttgggtttctggttttagtacttcactctcattgttttgggtttctggtttagcaggacgctcccattgttttggggttctggttttacacatcactcccattgttttgggtttctggtttagcaggtcactaccattgttttgggttccagtttaagcacatcactcccattgttttgggttccggttttagcatgtcactcccattgttttgggttccggttttagcacgtcactcccattgttttggatttctggtttagcaggtcactcccactgttttgggttccggtttaagcacatcattcccattgttttcatttccggttttagcacgtcactcccattgttttgggttccagttttagcaagtcactcccattgttttaggtttctggtttagcaggtcactcccattgttttgggttctggttttagcaggtcactcccattgttttgggttctggttttagcacatcactcccattgttttggatttctggtttagcaggtcactcccactgttttgggttccggtttaagcacatcactaccattgttttcgtttccggttttagcacgtcactcccattgttttgggttctggttttagcacatcactcccattgttttggatttctggtttagcaggtcactcccactgttttgggttccggtttaagcacatcactaccattgttttcgtttccggtttcagcacgtcactcccattgttttgggttccagttttagcaagtcactcccattgttttaggtttctggtttagcaggtcactcccattgttttcagttccggtttaagcacatcactcccgttgttttgggttccggttttagcacctcactcccattgtttgggtttctggtttcgcaggtcactcccattgttttgggtttctggtttagcatgtcactcccattgtcttgggtttctggtttagcatgtcactcataggttacggtgtccttatggttgcacattttttttttaatctcttgtcattccagttgaagagataccatttgacattttagagatggctgcatgcaaacttttaaaacatttgagtaagtacagtgcaccagggagactcttatgactattgggataacaccaagaatttggtatatgctccttactcagggtccccataaatcaaaccacctaaaatcaaatagattaaagaatgaattagataaagagtttacttgcttaactaagtggtttttttgttaattccctacaaccaaatctttataataccccatgttttctccacatgctgtaagtgttagcagctgcacagatacttaagataagagtctcatgatagtagagaagtcttgatctgtgatcttgggaaaagctgttaacattaaggatgtcatcttcttctggggggaactgtccttgttagctttaccttaagggttccaatgggcatgtggttccgagtgtggagggacccttctgagttgtgagactatgaacccaaagtttaaggttttaaagttttgctgtcatgtggatggcgagggcagtccttctctgatattctcagaagatccagtcatcagattctagattttgaagggtttgactgtcctcagtgaaccataaaaggctttctttacctggtgaaaatacacttcagggtaataatctactcttttaacatcaactctctcacatggaagagcttttatacaatcagaaaacatgcactgaaaatgaaaactgaatgaaatccctttataaaatgtttaaatggcccatcagataaccaaatgtacctgaagttttgattgttttcctaggaatataggtttcacaaaccaaacattggttataaactattttagcagtttagaaatcaccacaccaatatatttaatttggatcattttctctttccgtgatgagttatggaatgcagaacttttaataacaaaagattttaggacttaagaaggataaggtggccatcctggttcttcataggtctgtgcttaattaacatcagacttacatcctcttgaataccagctgtttctccaaattaggtgcaaggcactggtaactgatgagtagttataggtaatttgatttagaccatggaatttatttaaattatatatctaaacaatttcaatattggtgatttagcatgcaaatgtgacaaaatatttccttggtatacaatttttgttttacttgggttagcagttttacaaaccagttggactttttattaaatttttgatatttttttttttttgagacagagtctcactctgttacctaggttggagtgcagtggcacaatcttggctcactgcaacctccgcctcctgggttcaagcaattctcttgcctcagcctcccgagtagctgggattacaggcacataccaccacacccagctaatttttgtatttttagtagaggtggcgtttcacctttggccaggctggtctcaaactcctgacctcaagtgatccgccagccttggcctcctaaagtgctgggattgccgacatgagccactgcacccagcctaactgttgagaattcttagccagtctaattcttggggtatcggggaacttatggggaatttttacccatgatattaaagttattagaaatctgtgttcacgagtgtttttcagggtccttttcattctttcatgaatcttctaagagacaccatattctagaattttgcatgcttgtgaagtttttagaaactgcatcaccattaagcaattaactgtgaaatgactttagttatagttaaagacaattgacaaggaaatttggttatttctgtggtctacaataacttaataaccataattagggtggatgtggtggctcatgcctgtaatcccagcactttgggaggctgagatggaaggatcatgaggtcaggagatcgtgaccatcctggctaacatggtgaaatccatctttactaaaaatacaaaaattagcctggcatggtggtgggtgcctgtagttccagctactcgggaggttgaggcaggagaatggcatgaacccgggaggcggaagttgcagtgagccgagattgcaccactgtactccagcctgggtgacagagcaagactccatctcagaaaaaaaaaatacaagaattttagaaatcctatacaattttagaatggattgatgacatacactaaatataacctgaggaaggttccacattattttttgttttgacagtgcgacccatgtgacttaacatgttaaatagtcctgtttacctctcttttgggtgcttcaggggtctctgtagtatcccaaagttagaggtcagaaaagacaattttgaagttgaaatttgattttgggaagcctattaaatatattaaaggtttaaacacttgatgttatgaaatagaattccacatcaccgtaagtcattcatttacctaaaatcatgacttaaaaaatttttattttttatttttattttttattatacttttagttttagggtacatgtgcacattgtgcaggttagttacatatgtatacatgtgccatgctggtgcgctgcacccactaactcgtcatctagcattaggtatatctcccaatgctatccctcccccctccttccacaccacaacagtccccagagtgtgatattacccttcctgtgtccatgtgatctcattgttcaattcccacctatgagtgagaatatgcggtgtttggttttacgttcttgtgatagtttactgagaaggatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtccattgggtatatacccagtaatgggatggctgggtcaaatggcatttccagttctagatccctgaggaatcgccacactgacttccacaatgattgaactagtttacagtcccaccaacagtgtaaaactgttcctatttctccacgtcctctccagcacctgttgttttctgactttttaatgattgccattctaactggtgtgagatggtatctcattgcggttttgatttgcatttctctgatggccagtgatgatgagcaatttttcatgtgttttttggctgcataaatgtcttcttttgagaagtgtctgttcatgtccttcacccactttttgatggggttgtttttttcttgtaaatttgtttgagttcattgtagattctggatattagccctttgtcacatgagtaggttgcgaaaattttctgccgttttttaggttgcctgttcactctgatggtaatttcttttgctgtgcagaagctctttagtttaattagatcccatttgtcaattttggcatttgatgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagcatactttgaagtcaggtagtgtgatgcctccagctttgtccttttggcttaggattgacttggctatgcaggctcttttttagttccatatgaactttaaagtagttttttccaattgtgtgaagaaagtcattggtagcttgatggggatggcatggaatctgtacattactttgggcagtatggccattttcaagatattgattcttcctacccatgagcatggaatgttcttccatttgtttttatccttttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagacattgctgaagttgcttatcagcttaaggagattttgggctgagacaatggggttttctagatatacaatcatgtcatctgcaaacagggacaatttgacttcctcttttcctaattgaataccctttatttccttctcctgcctaattgcccctgccagaacttccaacactatgttgaataggagtggtgagagaggccatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcattgttgaattttgtcaaaggccttttctgcatctattgagataatcatgtggtttttgtctttggctctgtttatatgctggattacatttattgatgtgtgtatattgaaccagccttacatcccagggatgaagcccacttgatcatggtgcataagctttttgatgtgttgctggattcgttttgccagtattttattgaggatttttgcatcaatgttcatgaagtatattggtctaaaattccttttttggttgtgtctctgcctggctttggtgtcagaatgatgctggcctcataaaatgagttagggaggattccctctttttctgttgattggaatagtttcagaaggaatggtaccagttcctccttgtacctctggtagaattcggctgtgaatccatctggtcctggactctttttggttggtaagctattgattattgccacaatttcggcttctgttattggtctattcagagattcaacatcttcctggtttagtcttgggagagtgtatgtgtcgaggaatttatccatttcttctagattttctagtttatttacgtagaggtgtttgtagtattctctgatggtagttagtatttctctgggattggtggtgatatcccctttatcatttttattgcgtctatttgattcttctctctttttttctttattagtcttgctagaggtctatcaatttttctgatcctttcaaaaaaccagctcctggattcattaattttttgaagggattttgtatctctatttccttcagttctgctctgattttagttatttcttgccttctgctagcttttgaatgtgtttgctcttgcttttctagttctttcaattgtgatgttagggtgtcaattttggatctttcctgttttcccttgtgagcatttagtgttataaatttccctctacacagtgctttgaatgtgtcccagagattctggtatgttgtgtctttgttctcgttggtttgaaagaacatctttatttctgccttcatttccttatgtacccagtagtcattcaggagcaggttgttcagtttccatgtagttgagcagttttgggtgagattcttaatcctgagttctagtttgattgcactatggtctgagagatagtttcttataatttctgttcttttacttttgctgaggagaactttacttccaagtatgtggtcaattttggaataggtgtgatgtggtgctgaaaacatgtatattctgttgatttggggtggagagttctggagatgtctgttaggtcctcttggtgcagagctgagttcaattcctgggtatgcttgttgacttcctgtcttgttgatctgtctaatgttgacagtggagtgttaaagtctcccattattaatgcatgggagtctaagtctctttgtaggtcactcaggacttgctttatgaatctgggtgctcctgtgttgggcgcatatatatttaggatagttagctcttcttgttgaattgatccctttaccattatgtaatggccttctttgtctcttttgatctttgttggtttaaagtctgttttatcagagactaggattacaacccctgcctttttttgttttccatttgcttggtagatcttcctccatccttttattttgaacctatgtgtgtctctgcacgtgagatgagtttcctgaatacagcacactgatggttcttgactctttatccaatttgccagtctgtgtcttttaattggaacatttagaccatttacatttaaagataatattgttatgtgtgaatttgatcctgtcattatgatgttagctggttattttgctagttagttaatgcagtttcttcctagtctcgacggtgtttacattttggcatgattttgcagcggctggtatcggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctggctgctctctacatttttcccttcatttcaactttggtgaatctgacaattatgtgtcttggagttgctcttctcgaggagtatctttgtgtcattctctgtattttctgaatctgaatgttggcctgccttgctagattggggaagttctcctggataatatccagcagtgttttccaacttggttccattctccctatcactttcaggtacaccaatcagatgtagatttggtcttttcacatagtcccatatttcttggaggctttgctcatttatttttattcttttttctctaaacttcccttctcacttcatttcattcatttcatcttccattgctgataccctttcttccagttgatcgcatcagctcctgaggcttctgcattcttcacgtagttctcgagccttcgttttcagctccatcagctcctttaagaacttctctctattggttattctagttaaacattcttctaaatttttttcaaagttttcaactttgcctttggtttgaatgtcctcccgtagctcagagtaatttgatcgtctgaagccttcttctctcagctcgtcaaagtcattctccatccagctttgttccgttgctgttgaggaactgcattcctttggaggaggagaggcgctctgctttttagagtttccagtttttctgttctgttttttccccatctttgtggttttatctacgtttggtctttgatgatggtgatgtacacatgggtttttggtgtggatgtcctttctgtttgttagttttccttctaacagacagtaccctcagcttcaggtctgttggagttttctagaggcccattcccgaccctgtttgcctgggtatcagcagtggtgtctgcaaaaccatggattttcgtgatccgcgaatgctgctgtctgatcgttcctctggaaattttgtctcagaggagtacctggtcgtgtgaggtgtcagtctgcccctgctagggggcgcctcccagttaggctgctcgggggtcaggggtcagggacccacttcaggaggcagtctgcccattctcagatctccagctgcatgctgggagaaccactgctctcctcaaagctgtcagagagggacatttaagtctgcagaggttactgctgtatttttgtttgtctgtgtcctgcccccagaggtggagcctacagaggcaggcaggcctccttgagctgtggtgggctccacccagttcgagcttccaggctgctttgtttacctaagagagcctgggcaatggccggttcccctcccccagcctcgctgctgccttgcagtttgatctcagactgctgtgttagcaatcagcgagactccgtgggcctaggaccctccgagccaggtgccggatataatctcatggtgcgccgtttcctaagcccgtcagaaaagctcagtattagggtggcagttgcccgattttccaggtgccatctgtcacccctttccttgaccaggaaagggaactaactccctgaccccttgcgcttcccgagtgaggcaatgcctcgccctgcttcggctagtgcacagtgcacttcacccactgtcctgcacccactgtctggcactccctagtgagatgaacccagtacctcaaacggaaatgcagaaatcacccatcttctgcatcgctcatgctgggagctgtagaccggagctgttcctattcggccatcttggctcctcctcccattattttttaatattttctgaaaatcttctttaaagagagaaagccaaatgtcacccactttttcataaaaccttataggcaaatctattattcttttcttttttgagatggattttccctcttgttgcccaggctggaatgcaatggtgcgatctcagtttactgcaaccccctgcctcccaggttcaagcgattctcccgccccagcctcctgagtagctgggattagaggcatgccccaccatgtccagctaattttgcgtttttagtacagacgggtttttccttgttggtcaggctggccttgaactcctgacctcatgtgatccacctgcctcggcctccccaagtgttgggattacagccatgagccactgccgcaggccattttttttttaaagatagcgtcttgctctgtcacccttctcaccacattatagctctgggggccaagctgcatcacaatggaaatcatggagccacaggaagaatccactcagctttgcaagatgctgcccaaggggttgcttggagtaaccaaattaacatttttcattctgctcagagcaaaatatatgtgacaaaacatagacacgagccactttgcttaccacccagtgtcaaactggtaagactcaaacttgctcccagataggctgtgccatctctaaatctttttagaagcttctgcatgttaataggcatccctagatgagactaatttgggagccctcatttttaaatgcacttcagggcattattcatttggaatgttccactataagttatctttagtaagattttgccatttctgtaagactttgctgcttcccaggcctaatgaattagccaggaagaacttagttttccggaaattaaggatcctatttttacctaatatattggctttactcccaggttcccttgattgacttagccaatgattttttttcctacctaaacatgtgaggaaaatgaaacaaaggggcagaacacaaaaatccccgtgaatttccaaaagccaaattttacaatcctccaatattatcatttactaccactttccttctgacccattcagatgtaggaggcctctaactggaactggattcaagccagttaactactggatcaaatctgatcctggacccggtcccatttctgtcataacttctaaaacatccagccagtcatggctggatagcagtttggaacagaaatttgctcagagaaactcagctcaaaacacaaatccatggagctctgaaatccgagagagaatttaccacgatccccagatgctctgagaggtcaaagggcacaagtgttacagaatcctgaggcgtcacttttctgcctgaaacctctggctggtggcacctttacctgtgttttgctcgggcccactgtgttcgttctgtccactcggctcatgctagtggtctggatcccacacctgccaagggtgagctgggtacagagcagtgaagggggtgtgagcatgtgagcatgggatctggccactgcacacagccaagcatgccagctgcagtggggtgggcagctccaggtaccggcacaggtgccagctccctgtgaggctgcagctggaccagactgactgcaaacagcttccactgtgggtatcagggaatgcagtggtgcctggaagcttggagatgcaggaactgcagagccccaaataaggtgtcacagccctggcttggggagctcctaggtctgggctccctgaagggccaaagctcttgtctccttctctcttctcttcttcttgcctgcaatttggcaagcaaggggtgcgtttcagccctgtttatgttacatctctttcagccctgctagttggcaggtcccaagttcttgtcctgagtccaggaagaatgaggtatgtgggcaagtagaaggtgagcaaggtgaagaggtgctttattgagcaacagtacagctcagaggagacgtgcagtgggtagctcctttctgcaggcaggtcatcccaacgtctgttcagctctcagcagctgagagagatgcatggtggttagctatgcccacagtgcccaggcttttcgagcagaggagtgccttcaggccagtgctgagccactcttagcctcacttcaatgtccctcctgtgctcatcagttcccaaagtgtggagagggccgaggtggcagggggctggcatgtcagcactgccctgagcttgcacaaactgggctgggttgcaactgtgcctgggttcaacctcaacttggatccgaagttggagtgggctctcggagcggagagatgccaggtggtaggagcaggtatgactggacctgcaggggcaggggggcttgctgggcctctgagagtgcaaagatgcctgggtttgctgtcatgggtggatggctgcagctgtgcctgggagggtggggctcctgcttgccaatttagaagggctgggtctcccacccgttcctggctcccactaactttgaggagtgcacagccccagccactcctccccactgcagccagtgtctccgtagcaactgctccacatgggccactgttgccatcatagagcggtccttgcaggtgcctttcttgtacctcagcactcctgggggtcattagaagccctagcaacactgctcaccacactatagctccggaggccctagcagtcctgctcccacagatcccacttctgacaccatctattaaaagaaaatcttcagctgaattaaatttaaagaaacttaattgagcaatgaatgattcacgaatcaggcagcccccagaatcacagcagatttggtgagactccagcacagctacatggtggaagatttatagagaataaagggaacgtgatgtacagaaatctgaagtgaggagtgaggtccagaagcaactgggtcccttaccgttctcagcagtgaggtccagaaacaactggactggttacagtgctcagcatttgccttatttgaacacagctgaacactcagcagtgtgtgagtggcagaagtttggctgttgggattggccaggactcagctatagttacaggtgcatactccaaagttaggttatcagtctttctacctattaagttaggttgcagtttgtccacagggactcaaatctagaagtacagagtccttcccaggccatatttagttcactgtaacagttcctattatgacctcactgacagttctttttctctgaattttcctttcttctcaacagcttgtccaaatgttccattggtccctgttcatcccgccctgcagctctccttgactgattctgccctttgtggtttgcagtcctgtttctctacagcttggaccccttcagtctttccatcataggtttaactctctgttgaatgcttctttgtagctacgcaaaagttaccttaagctcaaaaaattcaaagtgaaagccacatcctcctctcttcccttatgtgtatggtattactaccatgcagccagtgacccaaaatgggatttcttctgggcttttcttgcttagattcaggctcatctggtgtcaagccttgttacttttgtttccttgttcttttatttttaattttttttcttttgagacagagtttcgttcttgttgcccaggctagagcgcagtggtgtgatcccggctcactgcagcctccacctcccgggttcaagcaattctcctgcctcagttcctgagtagctggtattacaggcatttgccaccacgcctggctaattttgtattttcagtagagatggggtttctctgttttgatcagggtggtctcgagctcccaacctgaagtgatccacccgcctcggcctcccaaagtgctgggattacaggcatgagccaccgtgcctggcctgcttgttgttttcatctcatcctgatttctgaatacaggagaggagctgagttggtgttcactaacaagcacagaagctttgttacatttacagtgtcattcttggcaaaacctgaatggtatgtttgtggggtgatgaggttcagtcccctgtgacctgtgtatctggccaacactgtggtgacatccttaggaatccatggggagagacaaagcattcaggagttagtgggtcacatttgacaagggccaataaagaaatatgcaaagacaaaaaacaagaagaacattgtcatattttataccttttgtttatataaatttatgtcaatgattctagcttaatgttaatatgcaatgtatacaatatgctaacatatacaatatatgtttatagtttaaacatttctgtcatgttttcagattctttaaagattatattacacttcctatttcagatagctgtttaaaatgagtaaggaaaaacggatgtgtgcatcagttctaactgtttatggactaaaactagttgattacttggttaagaacaaaaagtgacaacctaattaactgaaaattttaagtaggcaattatggttttagctttaatgtaaaatattaactatgctccattcttgcatttttaacctaatactcaatataaatcgccacatgccatgtttcagatcaaggttctacttgtgatctctcatgagtttttcaaggttttaattatctgagatataacaatgtacccgtaaccttactggcttaaaccaggaatttattctttttacatgtcacaattttctgggtcaagacactggacagggctgtgttggttggttgcttcatgatgtccctggtctcatctggaaggactctagtggctggggacatggagcaggcacccagccctctctttgtggccagcacggacttcctcccagtctggcagcatcaggtagtcaggtttgtctggcttctcccagggtgtgtgtccaagaggcccaggcagaagctgtaaggcctctcatgattgcccctcagaagtcccagagcatctctcctgccacactgtccagtcgtactcatcactgagacaagccatgattcaaggggggacgatgattagattccacctcttgatgagaagcatagtaggaacctgcagcagtctttaataaaccacagcgtgtcttctggccacaaactattaacgtttctcccacatgcaaattatgctttgcccctctcaagagccccagaatggttttccttatggcactggctagtagcccaactgaatcctgaatcaggttgtggtggcttgtcatctgcacccacacacactcagcagcagtgaggactgaagcaggttgtggtggcctgtcatctgcccccccacacacagccacagtgaggactgaatcaggttgtggtggcctgtcatctgaccccccactctcagccacagtggggactgaatcaggttgttgtgagctatcatctgagcccacaaactcagccgcagtgaggggactgctgtgaaaacagtcgacatttccctttagaagctttggtgggaggcaagagggaagtgctgccctgcaggcctcgtctaagagttggtcattcccatggggggcctgttacagttctgtgattagtgcccagtcctggtccctgagaacggcacccagtcccggtccctgagaatggtgtttgtgtccttttactcctccctctgggcttttgtcattctccatgttctttttgcttcagtgcctgggttgccgttgaccaactttccctgcctttttcttagggtcaatagggtattcaatggcttctttttcatttttttttttcttttcttttcttttttttttactttggccttttgagacaagaaattatttctttatattttctctaaattctgtttgaaagctgaaccttcttctttagatcatgtacctctcctgtcatatttattcagtgacagttaggggaggctggtagcactttccatgttcttcccagatgtctccttaggcagatccctgagatggtgcagtgccctttcagtttccatgttgtggccatagttttcccacagtccctcagcacgtaactctcaggccttttctccagtttccaatgacattttctcaccgtccttcaggccctgaccaagagtcttgatgcccttccaggttgcatgaatggtctccttgaggcccagttacaggtcagcctcacagtcgtgtcacatattgtagcttctgattaccacagcagctcatttccagctgccatattctgttccagttatctattctgaagtaaaacaactcattattacttgttttttggcttagagagtcttggtggtcagctcatctcacacacagttgcagccaagttggattgtgtgaaagcacagtggggtggtgtgcagggtggctcactagtggttgggagtggatgttgctgaaggctcaccagttgttgggagtcggtgttgctggaggctcagtgggggatgtcaatgcgtgtagctagtcatggactggtcttgtggtttccatcatgaggtctcaggggagtgggatttcctgcccagtgactggctttctcctggataagtgttctgttttctcagcctggcttctgaagtccccaaataccccctttgtcaccttctgttggccaaataagtcagtagtctggtcaaggtttaaggggaattggttctcacagagagaggagcaggaaagaatttgtcacctttagtctaccagaaatgagatttttataacaagtttattccaaatacattccagttccccttgtgaatacttttttgactcacagggtatttcaaagtttattacttggtttttagacatttgaggcttttctggatatcaatttgttgttggtttctaatttaatttcaagtgttcagacaacatactttgtatactatttcaggcttgaaccttttctcaatcgattgacatacagtttatcttggcactgccaagtaccatttgggccaggattttgtcatttagatccgtattttcctatatttttatctggttgttccatcagttactgagagagcagtattaattcaccagctataattttggattgtcaatttcctgcttttgttttgttgtttttgattcacatactttgaggctctgtgtgtgtgtgtgtagtttgtgtgcactttgaggcacaatttataattgtaacatcatcctctctgattcttttatttttattaaattaccctgtttatttctggtgatatattttgttctgaagcctctttcatctagtgttaacatctctgttgaagctttttatgattagtgtctggatagcatatttttatgtttagtgtctgcatagcatattttttctcatactttgtgtctttgtgtttaaattgtgtctctgtggatgccatattgttgggtcttgccttcctctcaggtctggcagtctctgtcttaagtagagtatttgtccagttacattgtaactaatcattgctaaggttggatttaggtctaccatttttctagatattttctatttgtttgtttattttttttttaagaaggttcttgctctgtcacccagactgtagtgcaatggtgcaatcttggctcactgcaacctctgcctcccaggcccaaccaatcctcacttgagccccctgagtagctgggactacaggtgcatggcaccacacctggctaatttttatattttttgtagagatagggttttgccatgttgcacaggctggtcttgaactcctgagctcaagcaatctacccaccttggcctcccaaagtgttcagattacaggcatgagccaccatgcctggccttcgtctgtcttttgatattctatatattctttcctatctacttttgggttaaatatttctaaatattccagtttgattaatcttttggctttttgaaatttttttataggctgggcatgttggcttatgctcataatctcagctctgtgggagtccaagggaggtggattgcttgaacccaggagtttgagaccagcctgggcaacatggcaaaaccctctctacaaaaaaaacaaaccaaaatttagccttacatcttggtgtgcacctgtagttctaactatttgggaggctgaggtgggagggttgcttgagcctgggaggttgaggttccaatgagctgtgatcatgccattccactcctgccagtgcaacagagtaagaccgtgtgtcaaaaaagatcattttttataaataatttataatttcgaattttggtaacaaacacttaccttaaaatttaccatcataaccagttgtaagtatacagttttgtagagttaagaatatttacattgttgtgcagcagatttctagatttttttttatcttggaaaactctatacccattcaacaactattaatttccccttccttccacctcctggcaagtactattctactttgtgttcctaaaaatttggcttatatacctagggttatataatatttgttttttaagtaggttccatgttatgtgcagatgtgtcaggattttcttcctttctatggctgaataatatttcttcatatatatatattttctctctctctctatatatatatatgtatatccttttgtttatccatctattcctggatggacgttttggtttcttccacctagtggctgtgtaatgctcctgtgaacataggtgtgcacatatctgtttgagttcctgctactagttattctgtctctgtagaagttggatggctggatcatatggtcattttattttatttttttgaggagccagttcatatttccaccaacagtgttcaagtgtttcagtttcacctgcacttgttactttcttttgggtttgaagtgatgtcccattgtggtttctatttgcatttctctaatgattagtgatgttacacatcttctcatatatctcatgtatctgttggctatttgtatatcatgtttgcatctttggatgaatgctctttgtccattttttaatcactttattttgttgtgttgtagcggggttttttggtcatgatcattcatttatctcacagttcattcttgttacttgggccagggtcatgatcattcattatctctcagttcatcctcattacgttgggcaaacagtcatgctgcagggtatagattatgttattctgttactttcaggtagaattggggtctggattctaattgtttctaagtttagattctgaatgagaatcagcagaggtagaccactgctgctgaggcctggggattgctgggaaaaaggcaggaaacagatacgcacctgaccatggagggtttatgtttcacggctcccatctgggtacccaaagaacctacatgtagctcgtgtgtggaaagcctacattgcccactcaaagcaattgaggatggaacagtcttggtgctggagctcattatttggaatgataaccacatctgcacagagaggacctgataagatgttgtccttccatgtatatctgggaatcctgtgtagggtctctctgtaaggacagggtcagtgttggcttcttggcctctagttagcttcacaagtagtctagtaaaggctttgcaaacctgtcaccatctgtggacattctggccagctcttgttttcaccctactgacttcttcagacactaggcttttgctttagaccagtcatggttttattcctcttcaaatcagtaatcaataaatcgtcttcaagtcaataaatttccactcctttaggaaaccctgatcttctggtcacaccaaggtttaattatctggtttgattgtttttctgttttcttggatttttttttccttcttcctgggggtttctagtaattctagtttgatgtctcactttctccattttttatttcttagttttcttctgtgattattttcactgcagctgcagggcctaatcctgggttggcagagaactagcacttattctgccctaattggaatccaggagagataggaggttccctagtgtgaaaatgtgtttgctcctctctgcttctggtagtctctctgtaggagttctttacatattctgaatgttcacttcttatgagatacatgatgagcaactataggttgaatgtctctgatccaaaaatctgaaatcccaaatgctccaaagtctgaaactttttgagtgccaacatgacattcaaaggaaatgcttattggagcatctcagactcaggtgtttgaatttgagatcctcaaccagtaagaataatgcaaatattacaaaatctgaaacatatcccaagcatttcaaataagggacactcaactggtattttttttaattttgcagtttgccttttaccctgttggttgtgacctttgaggtacagaagtttttaggtttgatatatttttgcttttactgcctgagcttttaatgtcatatcctaaaaattattgacaaattcatcgtcataaagcattttccaaatttgttttccctaggagtttgatagttctagttttacatttaggtttataattcactttgaattgattttaacgtcgtgtaaggtaagagtccaacttcattgttttgcatgtagttatacaattttcccaacaccatttgttgaagaaactgtgctttgccattgagtggtcttggcatccttgtggaagatcatcggaccatatatgccagggttggtttctgaggtctctgttgtgttggtccataagtgtgtcaagagtgtctttatgccattaccacatttttttttggcttattgcagttttgtaattgcttagagacctttaattttgtcctgtttcaagattgatttgcctattcatgggccctggagattccatatgagttttaggataggtttttctgtttatcaaaaatgtcattggaatctttataaggattgtattgaatctaggtcacttcgagtagtgttgacatcattccaagatgaaatcatctaatctgcaaacccagcttttcttttcatttatttgtgtttaatttcttttaacagtgttttgtagttttctgtgttcaaatcttttgccctcttggttaagcttattcctaatttttataatgctgctgtaaatataattctttttttttttttttttttttttttgagatggagtcttgctctgtctcccaggctggagtgcagtggcactatctcaggtcactgcaacctgcaccttccttattcaagcgattctccaacctcagcctctcaagtacttgggatcacaggtgccagccaccatgcccagctaactttttggtatttttagtagagacagtgtttctacatgttgaccaggctagtcttgaacttgtgacctcaggtgatctgcccgcctcggcctcccaaactgctgggattgcaggcatgaaccaccgcacccagctaaatgtcattctttttaaaaatttcttttcttttgttttctttcctttcttttctttctctctctttctttcctttctttctttttttttgagacggtgtctcactctgtttcctaagctggagcacagtggcacaatctcagctgactgcaacctccaccttccaagttcaagcaattctcctgcctcagcctcccaagtagctgggactacaggtgtctgccactatgcccagctaatttttgtatttttaacagagatagagttttactatttatattagagatggggttgacccagctggtcacgaactcctgacctcaggtggtccacgcgccttggcctcccaaagtgctgggattacaactgtgagccactgcacctggcctctttttaaaattttatttgcagattgttcattgttagtttatagaaatgcaactgacttgtgtgtgttactgtatcctgaaactttgttgaatttcattattctaccagtattttgtggaatttcaggatttttacacattacatcatgttgtctgtgaacaaaattttgtcctttttcctttccaatttgcatgctttttattactttctcttgtctaattattctgagtagaaattccagtactgttgtgaatagaagtggcaggaagagatgttgctatcttattcctgatcctagaggaaaagattttagtttttcaccattcagtatgatgttagctgtgagcttttcatgtataatctttatttactgaggagtttccatatattactaattctttgagtgtttttattacaaaaggtgttcatctggttctggaaccaggtaaatgttgacctgatagaatggattggaatgtccccttctggtttttgtacatttttggaatattttgcaaaggactggcattaattcttcttgaaatgtttggtaaaattctccagtgaagttatctggacctggaattttcttttttggggggtttttgattactggttgaatcttcttactagttacaggtctctttggattttttatttctccatgatgcagtatggtggtttgtgtatctaggaatttataaatttattctaggttgcccagttttgtggcatatggttgctcacattagtctcttgtaatctttttcatttctgtggaatctgttgtactgtcacctcttttatttatgattttagtatttgagatttctcttttttcttaatatagctgtgagttttaaaatttttattgatctttaaaaagcaaactcagtgtttttttttttcctttttttctgatcttattctgcttatctctattctaatctgttactttcttccttttgcttggtttgtcattagtttttttttttttttttccctttaggtgtaatattaggttattgatttgagatctttcttctttttaatttaagcacctgcaactataagcttccctttagcatggctttgagatctttcttctttttaatttaagcatctgcagctgtaagcttccctttaccatgggtttgagatctttcttctttttaatttaagcatctacggctgtaagcttccctttagcactgcctttgttgcctcctcctgagtttgggtatgtcatggttttgttttcatttgcttaaacatttttttgtcctattgtaatataattgtgttgtttttaatagaggtaattaatgaaacacataatgaattgtgcttctgtttttataatattttaagcattcttaactcagaaatgtaaattttagaaaaaaattccaggccaggcacactggctcacacctgtagtcccagcacttgaggaggctgaggcgggaggatcatctgaggtcaggagttggacaccagcctggccaacatggtgaaaccctgtctttactaaaaatagaaaaaaaatttaaaaaagcttgctgggtgtcatggcgggtgcctgtaatcccagctactctggaggctgaggcaggagaatcacttgaatctgggaagcggaggttgcagtgagctgagattgcaccactacactccagcctgggtggcagaatgagtccatctcaaaaaaaaaaaaaagaaaaaagaaaaaatttcagacatatttatttgtatttcaatttagaaactatgatctcctaagtgtattgacacagcaacctgacgtaaagataaagaataataagcatataacaaaacggaaacttgcaaatacctgttttttattaatttttaattatatatatttaaaaattgccggatgcagtgacttacacctgtaatcccagcactttgggaggctgaggtgggcagatcacatgaggtcaggagtttgagaccagcctggccaacatggtgaaacctcatctctattaaaaataaaaaaattagccaggcgtgatagcatgcatctgtagtcccagctactcaggagactgaggcagcagaattgcttgaacatgggaggcagaggttgcagtgagccaagatagtgccactgcactccagcctgcgtgacagaatgagactctgtctcaaaaaaataaaaattgggcacggtggctcacacctgtaatcgcagcattttgggaagctgaggcaggcagatcacgtcaggagatcgagaccatccgggctaacacggtgaaacgccatctctactaaaaatacaaaaagttagccgggcgtgttggcgggtgcctgtagttccagctactccagaagttgaggcaggagaatggtgtgaacctgggagttggagcttgcagtgagctgagattgaaccactggactccagcctgggtgacagagcaagactctgtctcaaaaaaaaataaaataaaactaaagtgtggttgacatacaaaaattacacatatttaatatatacctttgtgtgtgtgtgtgtgtgtgtgtgtgtgtgtgtgtgtgttacggaggttttactcttgttgcccaggctggagtgcagtgacatgatctcagctaactgcaacctccgcctcccgggttcaagcaattctcctgcctcagcctcctgagtagctgagatcgcaggcgtgcgcccctacacccggctaatttttgtatttttttagtacagacagggtttcaccatgttggcccggctggtcacaaactcctgacctcagatgatccacctgcctcggtctcccaaagtgctgggattacaggcgcgtgacaccgaatatatacatcttaatgagtttagagataagtattcgccccaggactcatcacaacaaataatgccgtaaacttgaccatcactccccatatatttctcattctcaccctttttaaaaaatgagaccgggagtggtggctcacgcctgtaatcccagcattttgcgaggccgaggcaggtggatcacgaggtcaggagatcaagaccatcctggctaacacagtgaaaccccgtttctactaaaaatacagaaaattagctgggcgtgatggcgggcacctgtagtcccagctacttgggagactgaggcaggataatggtgtgaactcgggaggcagagcttgcagtgagctgagatggttgcactgcactccagcctgggcaacagagtgagactccgtctcaaaaaaaaaaaaaaatgagatgaccatttcacctaaaatataccctcttaagttttattttaagtgtacaatacaggacggccatgcatcagagatatatgtgggtttggttccagaccactgcaataaagtgagttatacaatttcttttggttttccagcgcatgtaaaagtatgtttatactgtgctgtataaagtgtgcaatagcatatgtctacaaagtgttcacactttaatttacaaatactttattgttaacaagtgctaacagtcatctgagccttcagaaagctgcaatctttttttgtgtgctgacagggttttactctgtggctcaggctggagtaattgcagcctcaacctcatgctcaatcaaacccccacctcagactcctgactagctggaactacatttgcatgccaccgtgtccagctaatttttgtatttttttttttttttttgtagagatggggttttgccatgttgccttgacttcctgggctcaagcaatctacccaccttggcctcccaaggtgttgggatgacaggtgtgagccactgcacctggccaagtttcagtcttcttgctgatggagggtcttgccttaatgtaaggtggtggttgctgagcgttggggtggctgtggcaatttcttaaaataagacaccattgaagtttgctgtgtcaattgactctccctttcacaaaagaattatctgtagcatacggtgttgtttgatagctttttacccacagtagaactttcaaaatttgattcaatcctgtcaaaccttcatacagctgtaccaactaagtttatgtattattgtaaatcattgggttcaattctgtcaagccctccttctgctgtaccaactaagtttattctaaatctgttgtcatctcaacattgtttacactgtcttcaccacgagtagatttcatctcaagaaaccactttctttgctcatccgtggaagcaactcatccactcacgttttctccggaggctgctgcaatctcgccagaccttcaggctctgtctctgattctagtgctcttgttatttccaccatatctgcagttacctcctccacagaagtcgtgaacccctgtgtcatctgtgagggttggaataatcttcccaacttctctctctctctctttttttttttttttttgagatgaagtcttgcctgggctggagtgcagtgatgcgatctcagctcactgcaacctccatctcccaggttcaagcaattctgcctcagcctcccaagtgtttgggattacggtcaccccgaccaggaccagctaatttttttgtgtttttagtacagacaggatttcactatgttggccaggctggtctcaaattcctgacctcgtgatccacgttccttggcctcccaacatgctgggattacaagtgtgagccaccacgcctggccccaacttctcctaatgttgctattttgatcttattttttaaatcatgaatgttctcaatggcatctagaatggtgaatcctttccagtaggttttcaattattttgcccagatccatcaaaagaatcactttctagagaagttatagctttatgaaatatattttttacgtgataagacttgaaagttgaaattattctttgatccaagggcaccagaatgaatgttggtttagtaggcatgaaaacaatattcagctctttatacatctctgtaaaagcccctgagtacaaggggcattgtcagtgagtggtaatactttgaaaggaatcttatttctttagcagtaggtgtcaacactgggcttaagatattcagtaaaccgtatttgtaaaccgatagtctgtcatccaggctttgttcccatttgtagagtacagacagagctgtgttttatcataattcttcagggccctcggattttcagaatagtaaatcatcattggtttcaagttaacatcaataactgcattagcccttaacaaaagagtcagcatgtcctttgaagccttaaagccaggcatcaactcctctctagctgggaacatcctagatgacatctccttctagtagaaggctgttttgtctccattgcaaatctatttagtgtagccatcttaattagttatcttctagatagctttctgcagcttttccatcagtacttgctgctttatcttgcgcttttatgttatggagatgacttttttccttaaacctcaagaaacaagctcttctagcttcagactttccttctgcagctgcctcaccactctaagtcttcatagaattgaagagaggccgggtgcggtggctgtcacacctgtaatcctagcactttgggaggccgaggcgggcagatcacctgaggtcgggagttcgacgccagtctgaccaacgtggagaaaccccatctctactaaaaatacaaaaaattagccaggtgtggtggtgcatacctgtaattccaggtactcgggatgctgaggcaggagaatggcttgaacttgggaggcagaggttgcgatgagccaagatcatgccattgcactccagcttgggcaagaagaatgaaactctgtctcaaaaataaagaaaaaaaagtaaaaggagagttaggcttaggcttaatggaatgttttttgtttttattcatcttctatctagaccaattaaactttcttcataacagcagcaagattgtttagctttttatcattcatgtgttcactggagcagtactttaaatttctttccagaacacttcctttgcattcacaacttggctaagtgtttgttgcatgaggtctagctactggcctgtcttgcttacagcatgccttcctcactaagcttaattatttcttccttttggtttaaagtgacagacatgcaactcttctttcatgaacatatagaggctattgtagggttattaatgggccacattttaatattaataaaaagaagccagagaaaaagagaaagagaaatggcccgttggttgggcagtcagaacaaacgcatttgtcaattgtttgctgtcttatcctggtgtgatttgtggttctcaaaacaatgacaacagtagcattaaagatcactgattacagatcaccacaacagattcaataataaaaatcttaaaatactgcgagaatgaccgaaatttgacacagagacgtgaagtgagcacgtgctgtaggaacaatggtgccagtgagaactgcttattgcagggtggccacaaagcttcaatatgtaaaacacatggtcacaaaatacaataaagcaaagtgcagtgaaacaagatgtgtctgtcttttgatagactgtgacaatctctacctttgaattggtacattcataccattaacattcaaagtgattattgatatcattggattaatatctactatatttgttactgttttctattcattctcctcagtctccattcttttgtctaccactctttttctcccttttgcagttttcattgatgattttagatgactacattttccctgtctttcttagcacgtacttctctttttaaaaccttttttaactagttgccacagaatttgcaatatacatttacaaccaatgcaagtccactttcaagtaacactatccaactatcccacaaataagactacctgcttaacaaacaaaacacctaattcctcagtaacatttacaaccaattcaagtccactttcaaataacactatcccactatcccacaaataagactacctgcttaacaaagaacacacctaattcctcaatatacatttacaaccaattcaagtccactttcagataacactatcccacttcacgggtgactacctgcttaacaaagaaaacacctgattcctccctcccatccttccattccattccttgtattattgttccttatttcacttgtgtataagcatgcataatctatctgtgtgtattcattattatctacaaacttattggtcagatcaattatgaataaatacatgtttttattgtaccacaatgcctccctcccatccttccattccattccttgtattaatgttactcatttcaattgtgtataagcatacataatctatctgtgtgtatttgttattgtctatgaacttcttggtcagatcaattaagaataaatacataggtttttattgtaccacaattctttctttaatgctctttttaaaaaaatgttgatccaggtttcagttacatatcttttgtttccctaaagaatttcatttaaaatttcttgcaagacaggtctcctggcaacaagtttcttgaatttttatttttctgaggaaggccttaattctccttcacttttgaagggtgttttcagtgggtacagaaacttaggttggtgggtttttttctgtcaacattttgaatttttcatttcactgtcttcttgctttcacagtttctgcaatgttgaatgcagttcttatctttgtgtctctgtaggtaaggtgttttctgccccacctctggtttctttcagagttttcctttatcttttatttcatatagtttgaaaattatatgtccaagtgtaggttgttggcatttattctgcctggtgttctcggagcttcctggatctttggtttggtgtctgacattaatactggaagttctcagacatggttgttgcagaactttcttctatttcttctcctcctggtattctcattactctgtttcaccttttgtagttgtcccacagtcttgaatatcatcttctgttcttttcagtgtttcttttctttaggttttgaagtttctgatgataaatcctcaagctcagagatttttactcagctgagtccagtctactaataagccatcagaggtattcttcagttatttaccacgtttttcatcactacattatgttgaaagttcttacgatgtttgtctttctgataacattacccatctacacttgaatactgtctacttcattcattaggcccttagcatattctccagaggtttaaaaaaaaattccaaaatcatatctttgtctgcttctgaagcttgctcttttgacacaaattgtatttttttctttttttggattttagtatgccttgcaattttttccctttattctcatgcatgaagcacccacgaaaagtgactgctgttagtatagcttcagtaatgcggtgatgaggtgacagggcaggtgatgctctcttagtctctttaggctactataacaaaatacttcagactgagtaattcataaacaacagagattattgctcacagatctggaggctggaaagtccaagactaaagggccaggatatttggtgtttgttgaaggtcaaacattcagacactcacaatgactatagcgacagcagcagtcttcaggaatcctatgtgagggacaaacactcagaagccagctggagtgttctagaatcctatgtgagggccaaacattcagaccccagcagtagtgttgtggaatcctatgtgagggacaaactttcaaacccttgtagcagtgttccggaatgctatgtgagggacaaacattcagaccacgggagcagtgttctggaattctatgtgaaggacaaacattaagactctcatagcagtgtcctggaatcatatgtgagggacaaccattcagacaccagcagaagtgttctggaatcctaggtgtgggaaaaacattcagaacctagtagcagtgttctggaatcctatgtgagggacataccttcagaccacggcagcagtgttctggaatggtatgtgaaggacaaacattcagacccttgtagcagtgttccggaattctatgggagggacaaacattcagaccacagcagcagtgttctggaatcctatatgatggaccaacatgcagaaccttgcaacagtgttctggaatactaggtgagggaaaaatattcacacccttgtagcagtgttctggaattctatgtgactgacaaacattcagactccagcagcagtgttctgtaatcctatgtgagggaaaaacattcagatcccaagagcagtgttctgaaatcctatgttaagggaaacattgagaccccagcatgaatgttctggaatcctatgtgagggacaaacattcagaccacagcaggagtgttctggaatcctatatgaggtataagcattcagaccctcatagcagtgttctggaatcctatgtgagggagaagcattcagagcacagcaggagtgctctggaatcctatgttagggacaaacattcagaacctcgtaacattgtgctgggaacctatgtaagggacagacatttagaccctcgcagcagtgttctggaatcccatgtgagggtcaaacattcagatcctcgcagcagtgttctggaattctatgtgagtgacaaacattcagactccagcagcagtgttctgtattccaatgtgaaggacaaacattcagaatccaggagcagtgttttgaaatcatatgttaagggcaaacatacagaccctagcatcaatattctagaatcatatgtgagggacatacattcagaccctcgcagcagtgttctggaatcctagatgggggacaaacattcagaccccagcagcaggcttctggaatcctatgtgggggacaaacattcagacaatggcagcaatgttctggaatcctatgtgagggacaaacactcagagccttgtagcagtgttctggaatcctatgtgagcgagagtgcctggagcctacccaacctgacgcccccaaagccctcacagggtctgacctcccagcatgcacctgtctctccctgaaccccaactgcccaccctgccttttccctggcctcctccatcctgtgcagcccatagactgtgaccttctctccagccactctggcccttcctttacctttgtcctgtcagaatctctgagcaggatctcccaggtccatccaaatacgtgctttgtccacttctgactaggcccttgggcatcactgggctatcccagctgtccacaaggccttcaataatgcacattgcacctggcttatccaagcagtgctcagcagcccacattgaccaggtccctgctgaccagaccctgcacatcaggtcctccctgatgacaccctcactgattagaccctcatgaccaggccccactaacaaggcccccactgccaggcacacaatgacaaggactccactgaccaggaccttactgacaaggcctcactgacaaggactcatggactaagtccttactgacaagtcctcactgactaggtcattattgacaaggcctcactgatcaggttccactgatcatgacctcattccctggccccaaagatgaggccccactgaccaggcctccagggaacaggttgccactgatcaggcccctaataacgaggccttatgtcaccagatgcccctgactgggaccctagtgagtagaccccactgaaccggcaccaaatgctgagatccccgctgaccaggtcaccctgtagaccggtgctacaaaagtcaccactgaccaagtcctctctgaccaggacactacagattaggtcccaccgacaaggctgccctgaccagggccccactgacaagggcctcactgatgaggacacgcccaccagagtctgctgactaagtcccatgtgcccactcctccactgaatagcaccccttgacctggtcactagtgccccaacccatgctgaccaggccagcactaagccccagctgaccaggtctccactgatcaagccccacagcccaggtttgcactgaccagacaccaaacaactggcagccaataggtccccactcaccaaaaccccactactagaccccactaatgagaccctctctaagcagacccctgctgaccacgatcccactaaatagtcctcactgacctaggtccactgaccaggcccacactgatcaggtccctcctaaccacgccggaaatccaagcggcaatgacatgtttcatatggcagaagttggaacaagacagagagaggaaagaggttccacagccttttaaactactagatctcatgagaactcactcactatcaggaggatggcattaagggcttggtgctttgccatttgtgaaggatccactcccactcctttatgattaaagctttttccacctaggccccgactctaacattagggagtgtactttcacatgagttttggaaggggcatagagaaaaaccgtattattctgtccctgaccccacaaatctcatgtccttctcacattgcaagatacagtcatgccttgccagcagtctcccaaagtcttaactcatttcagcattaactcaaagttacaaagtccaaagtctcatctgggtcaaggctacattctcttttgcctacgagtctctgaaataaaaagcaagttcactgtgtctaaggtacaatgatggtacaggcattgtgtaagctttccatatccaaaagggagacattttccagaaagcttcttatttttatctgaggccccctcagcctggccttcactgtccatgtttttgtcagcattcttgtcacagccatttaaccagtctctaagatggtccaaaaatgttctcatctgtctgtcttctttggagccctccaaactcttccaacctctactcattacccagttccgaagttgcttccacattttcaggtatctttatagcaatgctccagtcctcatttgccatttttggtaagatttattttgaaaaagaggtttaattggctcatggttctgcagagtggacaggaagcttagtgcttctgcttctggggggcctcagaaatctttcaatcattgtgcaaggtaatgaaagagtgaattgtctcacatgacaagaggaaatcacggagagtacggagtgatatagagttttcagtggccagatctcacgagaagtcactcatgattgtgaggacagtaccaaggggatggtgctgaaccactcatgagaaatttgccttcatgattccgtcaccttataccaggatccacctccaacattaggaagcataactcaacatgagatttggtggggacacatattcgaattgcctcatcagtctttgagtatacagacatccatagcaggctttatccagccagcttctttgggattctttatagggtttcagatctataggatatccactaaaatattcctacttcaaaaggcaataaagtaagtggtattatcattcttcaaaaagttataatggtagtgtaggcattcatagtatgatttagttcatttgctactgtttctattctatcaccatattaacactttcctacacaattctatattcagctgggtttcagttgagcacaaagtcatccttgtactaccaccgatagctggcaccagctctttgatactgttatcattctgctgtagaaagtacccgtgaactggaaaaagtccacaattgaatagctagtcattcaacactatcaaattttaggtgactttttgaaaaaatagtatctcttgttgcaagaaatgttccatctgtgatttcaagtctctcacttgagtgaattggatggaagtggtaaatttcagccaaagtggccaaagaaatcctgttcctgtgataatgacgccatcagcctctgcacctctgtcttcccttctgccacatgttgcctgttctccgtgactttggtaagagcttccttgtgtatgtggatgatgtccaggatgtttgtcttgtgtccctgagacagcactaacaggtccatggctgggtccaggtccttcctggactgactggcaaggagcttactgatgttcttgaaggcatctctggtgaagtggatggcctagtcaagttccaaggcctggctgaggctgaagaaaaactggccaccttctgatgctctttctaaaagcctgtcactgtcatttgcttgcttgtcaactcattggctgtgaggttgaactgagtggcctgtgtccatctttttggggaactatttgaagccatcagtcttgctctcccacccctaaaggttgatggtcaccacctgggggtgtgctgagggtcagaaagaagccagcactcactatctcatccttctcagctttcctcttgcactctctccaggctgtctcttcagtggtggtgggatatatcagaaagtgatggaagatgtggcactgtgcccacacctagaagctggccatgtggttggctcatccaccagaatggatgctccgggtgctctttgagccagcttggccttgcctagcatgcacaggctccaggtaccgacatgttgctctgagtgagcttgtcctgctttgggccaaattctgtcaggccagggccacaagaggccgagtcccacgggtggtaatcctggctgctttctacacttccacacaaagacctcctgaagatggcctgtggtctacctctttgcaaccaagaagcccgcagtgccatatgaatcctcaggcatggactggagcccccgaggaagcacacaccctgctcctgagcctgctgctcattttctctgtgtggctccatttgtgtcacagttgttgcacagacttgtgcatgctgggcaaggccaagctggctcaaaaagcaaccagccacctctgcaaggttgtgccaggagccggtggaccggccaccaacctcactcactgcttgtcaggttacatcagttattctaccctagaggtagggccacagtgccatatgcttttcctcaggcctctgctctatcagtaatcaggcggcaaccactcaggctgtgggaacctggccatccctccttccttgagtagctgaggttgctggcttgtccgcctactacaggcacagccttgcagatgtggctagttgctctgagccatcttggccttgcctggcatgcataggccccaggtactgacactctgctccgagtcagcttgtcctgccttgggtcaaattctaagtctggccagggccacagaaggcccagtcccctgggtgctaatcttggctgctttctgcacttgaacataaagtcctcctcaagacagcctgtgttctgcctcttggcgaccaagaagcctacagtgccatacgagccctgaggcatggactggagccacaaaggcagtgcacgccccattcctgagcctgctgatcatttcctctatatggctccatttgtagcacacttgttgcagtgaggcttgtgcatgtcaggcaaggccaagctggctgaaagagcaagcagccacctctgcaagggtgtgccaggagcagatggaccagctgccaatctcactcactgccagacgtggtacatcagttcttctaccctaaaggtggggccaagatgcagaccacaggccatcttgaggaggactttatgttcaagtgcagaaagcaggcaggattaccaccctgggtactcgcccttctgtggcctgcagtgccatatgagccatgaggcatggactagtgccatctgctttatacaaaaattaacttaagattgattaaagagttaaatatgccacctgcttttcctcaggcctctgctccatcaggcatcaggtggcagctactcatgctgttggaacctcaccatccgggcttccttgagtgggtgaggttgctggcttgtctgcctgctacaggcacagccttgcagaggtggctggttgctctgagccagcttggccttgcctggcatgcataggccccaggtactgacactcttctccgagtcagcttgtcctgccttgggccaaattctaagtctggagaggaccacagaaggcagagtcccctggatggtaatcctgactactttctgcacttgaacataaagtcctcctcaagacagcctgtggtctgcagctaggcaaccaagaaacccgcagtgccataggaaccctgaggcattgactggagccccaaaggcagggcacaccctgcttctgagcctgctgcttgtttcgtctatgtggctccgtttgttgcacagttattacactgaggcttgtgcatgctgggcaaactccaagccactagaatttggtccaaggcagaacaagctcactgggagcagcgtgtcagtacctggggcctgtgcatgccaggcaaggccaagctgccttaaagagcaaacagcctcctctgcaagggtgtgccaggagccggtggacccaccaccaacctcactcactaccggtcagggtacatcagttgttctaccctagaggtagggcccaactgccatctccttttcctcaggcctctgcttgatcagccatcaggcggtggccactcatgctgtgggaacttggccatccctgcttccttgtgcagctgaggttgctggctgctccacctcctccagaagcacccttgcagtggtagctggttgctctttgagccagcttagccttgcctagcatgtacaggccccagctactgacacagtactccgagtgagctggtcctgctttgagccaaattctaagtctggccggggccacagaaggccgagtcccctgggtggtaaacctggctgctttctgcccttgaacataaagtcctcctcggctggtctatggtctacctcttggcaaccaagaatcctgcagtcccatacaagccctgaggcatggactggagccccaaaggcagtgcacaccctgcttctgagcttgctgctcatttcctctgtgtggctccatttttagcacagttgttgcattgaggcttgtgtatgctgggcaaggccaagctggctcaaaaagcaaccagccgcgtttgcaagggtgtgcctgaagtggttggactagccatcaacgttgcccactcaaggaagcaggaaatgcatgtttgtaccatgcatttcactacaggtcatttcccctgaggttggtggcctaggttttcttatagattttttatggttttaggtcttacttctaactctttcatccatcttacttaatttttgtttaaggtgtatgggtgtggcccagtttcagttttctgcatttggctagccagttttcccaacaccatttattaaatagggtatcctttcccattgcttgtttttgtcaggtttgtcaaagatcagatgcttttaagtgtgtggtgtcatttctgaggcctctgttctgttccattggtctatagatctgatttgttaccagccccatgctgttttggttactgtagccttgtagaataatttgaagtcaagtactgtgatgcctctagctttgctgtttttgcttaggattttcttggctatgtgggctcttttttggttccatatgaaatttaaagtagtttttctaattctgtgaagaaagtaatggtagcttgatggggacagcagtgagtctataaattactttgggtggtatagcactcaggcacagaaatgtccttgtgttaggcaataccattcaggacatagccataggcagagtcttcatcactataacaccaaaagcaatggctacaaaaaccaaaatttacaaatgggatctaactaaacttaagagtatctgcagtgcaaaagaaactattatcagagtgaacaggcaacccagagaatgggagaaaattgttgcaatctatccatctgacaaagggctaatatgcagaatctacaaagaacaaacttacaagaaaaaaaaaaaaaaaaacaaccccatcaaaaagtagacaaaggatatgaacagacacttaccaaagaagacatttatacagccaacgaacatgtgaagcaaagcacatcatcactggtcattagagaaatggaaatcaaaaccacaatgagatacaatctcacaccacttagaatggtcatcgttaaaaaatcaggaaagaacagatgctagagaggatgtggagaaataggaaagcttttacacagttggtgggaatataaattacttcaaccattggggaagacagtgtgacaattcctcaaggatctacaaccagaaatatcatttgacccagcaatcccattactgggtatatacccccaaaattataaatcattctaatataaagacacatgcacctgtctgtttattacggcactgttcacaacagcaaagacttggaaccaaaccaaatgcccaccaatgatagactagataaagaaaatgtggcatatacacaccacgaaatactatgcagccataaaaagggatgaattcacgtcatttgctgggacatgaatgaagctggaaaccatcattttcagctaactaacagaagaacagaaaaccaaacaccacatgttctcactcataactgggagttgaacaatgggaacacagggacacaggaaggggaacatcacacaccagggcctgtcagggtggggggctaggagagggatggcattaggagaaataactaatgtagatcatgggttgatggatgcagcaagccaccatggcatgtgtatacctatgtaacaaacctgcatgttctgcacatgtaccccagaacttaaagtataattaaaaaaaagaaatttgcttttaattaagcttttaatcatagaacttgtaaagaaaatccttttgaatcttttattaccacatcatagctgggacaaactgctgacgctttaaaagtaacacaaatatcaaacagaaagaactagacttaggaaccaaactcaggtttctgtagtgaacagggcagaatcttcacattgggtcaccaccactactccttcagtttagccttggctagcaaaagggtggccttgttatgtagatgagaccacttatgtaaaaaaaaaaaaaagttttaaaaaataatttctgctaactggaatgttttttgttgttgtttatttgtttgtttgtttgtttgcagccataggagttttagccaattcagaggccttgctgcccacaatttggaaaattcctttggatttgaccaagtcaggaagagacgggagaaaagtgaaacaacaacaataaagccccaagcataaacagacaaaaagagttaagcaaaacaacaaatgcacaattcatatgattactgagtgttctaatggtaaggagaaactaaaagcagaaattaaaagcagctggtgagtaatcttaaattttagtcattaaggaaaaattttaagacaaaactctaattcagctacttacctggaaacaaggctcaggctggggatcgttctctgccatcttagaagctggaaacaacttacactcaccttccctgtcagaagcaagctgaaactcaggaaaggaggtgcctgctctccatcaccacagaagcaggaaaacttgccttccttgttggaaatgagtaaaacttcagaaaaggagttgtacagcaaaatcaaacttagatctcaaccagattttgggagatcagggactctttgcaggggagaagctccacaacctcagcaaattatcctgttggtttgggcaataaagatagcccaggttggtagcaatcaataatgagatttatcaaaggtcaggaccacctttgtaatgtccttctctgtctttttttatctttattggtatatacgttttgtcgaaactgagggtgtaacacctgatttcttctgttttccattggcttgaaagatttttcaccattccttcattttgagcctatgtatggcactgcaggtgagatgggtttcttggagacggcatactcaaatgggtcttggttctttatccagcttgcccccctgtgtctttcaatcggagcatttggcccatttccatttaaggttagtaatggtatgtgtggattagatcctgtcgtcctgctgtcagctagttattttgcagacttgtgtgtgtggttggtttttagcattactggtctgtgtacttcggtgcatttttgtagtggctggtgatggtcttttctttccatatttagtgcttcattcaggagctcttgtagatctggtgataatgaattctctcagcatttgcttgtctgaaaaggatcttgtttctccttcacttatgatgcttaattttgctggacatgaaattctgggttgaaatttctttttcttttaaccatttataataacaccatgttattatatggtatatctgtctctgccatactacgtgaaatttcttttctttaagaagttgaatatcttttctggcttgtagggtttcagctgagaagtctgctaagtctgatggaattccctttgcaggtgacgttgcctttctccctggctgcctttaacattgtttctttcattttgaccttggagaatctgatgattatatgtcttggggatgatcttctcgtggcttatcttactgaggttctctggatttcctgaattggaatgttggcctgtctggataggttggggatattctcatgaatgatattctgacgtatgttttccaagttggttccattctcctcatctctttcacgtacactaatcagtcatagattttgtcgtttatataatctcatatttcttggatgttttgttcattcattttccttcttttttcccccattcttgtctgcctgttttatttcagaaagccagttttcaagctctgggattctttcctctgcttggtctattctgctgggtggtcttgcacatgagatggagctggtgtgacctcagccctccttagtctgcttgcctctcccaggaccccagcctggccacacctgcttacagggcaatctcgggtgcccacaaacactacaataattttcataatgcaatcacacataatcactatgtgactgcattatgaaaattcttgtagtgtgcttttcagctctattaggtcggttatgtcttctttatacttgctattttgtctgttagctcctacaatgttttacaatgatttttagctctgttgtattgcatgacaacatacttctttcactcagtgaactttgttcctacgcatatcctgaaccctgcttgtatcattccagacatctcagcctcagcccagttctgaacacttgctggagagttgatacagtcatttggaggaaagaaggcatgctgactttttgagttttcagtgttctcacacagattctttctcatctttatgggcttatccaccttccatctttgaggttgctgaccttcggacagggtatttttcttttattgtatttgatgatcttgagggtttcattgtgggataaggtggattcaaccaactggctttgtttttggaggattttaggggggccaatgtgcagctcccaattcctggactttgtgctttaactctggggaacttgtcttgagccccaactttgttctctggctcttggaggtttggagtccactgcactgaggggaccaaagtgtgtcaactgtggcagaatgctagtggatgcaaaagtccctgcctccctgcgggcgttcacccagtggtggaggcaagacagctggggtgtgggccaggggtcccctgctgtgtgtgtgttgcactggaggtagtgttggttcagggtgggctgctggccagtgcaggccatggtgccttctctgtgcccctcaaagcaaccgtggtcactcaggttataagaaggtccctttttctctgcacagcattagctcaagggttaggtgctggcaggggtggggttcttggttctgtgcccaccaaggctctgtcttcaatggcagttggtgtgggttggggtgtgtcctgcactcccctgtgctgtcagggcaagtacagcaaaacccacatgtgtaaacacacacagcaaagtgatgtaggaagtttccatataaagggctgcagtacggagaggtaatgtgcaggctggtgcgtggctgttggggccaccttgctgcagctctccactgatcaggtacagtccactagcatggaagctatgctgtgggcatccgagagtgccctgtatgcaggtgtggccaggctggggtcctgggagaggcaagcagactaaggagtgctgatatcagaccagccccatctcatgtgcaagactgcccagcagagatcaggtctcagaggagaactctctcaaaagtgaacccccggcacagcatagctgctttacacaaacatggccaggcttctgttttaagcaagtcccctttttgaagaggggaactctgggacctgatctctgctgggcaatcttgaacatgagatggggctgatctgaacttagcattcctaaagtgctgggataaagtatctcacaagggcacgtggagcctagagagatagctgtccctgccctctgggctccacatcacctgacttgctgctccaccactctgcttgtctcctgggtgctccatcccatagagatgtgagttagcaatcacttagcgtaatcagcccaggatggagggtctgtattgtgaggtcaagccagtgttccctctctggtgatgagcagtggggggtgtgtggtacccgtgggagatggactggcttgttcattgggtcaaccgcagcttattggaggtgtcaatatggcacttagggtctttgctcccttgatattctgagggtagaaagggcagtttcactgcagaggcaatggaagagagaatttcgtttgctcctggaagctctgtccagggaattgctgagttgctactggctggatagctctgatggtggactggctggagacccaggtcagtaggacctgcccatcaagtagactgtctggccacttttctgtcaggctgctgtggtatgctgggggtcccctccagtccctaattgccttgtattttccagggaagatgatagcctgccccttcctctgggagctctgtgccactgaggtacgaacttgttgccagtatgaacacacctataagatgtgactggagacaagttgagaagtcttatctagtcaggaggaacaaaaacaggcactgacttaaaaaaaaagtctgggcacgtttttctagagcagctgtgctatgccgggtgttcacttccactcctggttgcctcagacactctgaagccctaatgctgaaatggctgagttgccccaacagcaaagacaacagtctggtcctccccctgggagctctgactcagggaggcctgaaacctctgtcggccagagaacagcagtgagggcagctggagaccctggttgaaagccttcacctgctgattagaaatgtggtcggggactgacttaaacaagagtctggccacgtttttgtagtgtggccgtgctgcgctgaggttcctcttccaccccttgtcaccttgggctttccaaagcccgcaaaccagaacggctagtcacccaaacagcaaaggtggtggcctgcccctctctctgggagctctgtcccgtgaacacttcaaatttctattggccaaggaatgctggtggtggtagctggaggccccatttgggaggtcctgtacagtgatgtgcaacaaggtcgggggcctgcttacagaagcattctggccatgatttggtaaagcagctagctgtgctgtgggatctcttctgccccttgtcggtttatactctccaaagccctcaggctggaatgactaagttgcctgaacaggaaagatggcggcctgccccatctattctctcagagttcatcttgtttgatggagcttaatttttagcctgttaattttactgtctacattagacttgttcggaaagaatctgctatattttaggttagatatatgagaattcattgttttctgtaaataaacctgttcatgtcttgttctctggaaagaaatctctttcaactatctgactttggtcacagtcatatagagcagtagccagtctataatgacataattgaatttccatttccagtgttttgtttttgtgtcttacattgtacagttcagaaatgagcattttattcccaattgtcaaaaagctaagctgtccactgtactgaaatactgtttttgttaatgcttcgtcattcaattttttaaaggtgaacacttttatccaacttttctcacgtcagagtacaggtaagccctggctgccttgagccactctcagggagaccaaaacccttcatacattacaagttggggtacaaaaaagtggggccatgaaggctagtcattcaaaataaaacaaaatttgaaagtattaaggcaaagatttaaaaaattttgcattatgtaatttacacaaaagcaatgctatcgcctaccatgtgtgaactcgggagaggactgggccattctccttagagagaagtagggtggcttttaggagggcaaggggcttcctgaaacaatgcatctcacaatatttggaatgactattgaaaataagaacattgtacaatcaaagtccttggcgacattgtagaactagcgggtgctgacccctgagccacaaccacagttctgggtttggggtttggtaaaaccaccccaaggacagagttctggggccgggttttggaggaaccaaggcgcctcccagggatggtgtgtcactcctgcttgccatgaaatgtgcacacaggctgtccccctgcccatcccatcctgctggacaggatggaggaagtgagggaacaggcagggtggacagctggaattcagggagaggcaggtgcatgctgggaggtcaggacctgtgagggctgtgggggcatcaggtggagtgggctccaggtgcaccctcagtgcacagggcaagtctcaggccaggctccctggaccccggctgggtgatgtggtcactccctgggggactgctgtcagaccctggccaccctccctgggcagcaccgtcccatcccagaactggactttctgagtcctaaaacaggacagtgctgcccaggcctgacagactgggaggacctgtgaagtcctccatccctagaccagcctcccaacagcagggacagtctcctacctttaccttcaggtaaaggtactgatacatctcattctaaggcaaccaaggcagagctgaggacctgtgccaggctgggagccagtcctctccctaaatgggccttagggaagcctcatccctgtcccagtgcactgcaagtttcagcccaggagacacatagggaagtgaggaaggggcctccccactggctgaccctggaaaagtgggacctgggagaagagggagtgcagggctggcaggggatgctccaggcccatggagagctcaggctgcaccaaggggctgcccctcctgggctggaggctgtgctctctacagtatctgaggaagtccagtcctgagatgggacagtgctacccagggtgggtggccagcacctgacaacagtctcccagcaagtgaccacatcacccggccaaggtccagggagcctgggccaagacctgcccagtgcgctgagggtgcacctggagcccacaccacctgacgcccccacaaccctcatagggtctgacctcccagcatgcacctgcctctccctgaaaccaagctgcccaacctgcctgttccctggcctcctccatcctgtgcagaccatagactgtgactatctctccgaccactctggcccttcctttacctttgtcctgtcagaatctctgagcaagatctcccaggtccatccaaacacctgctttgtccagttttgactgggccactgaacaccactgggccaccccagctgtccacaggctcctcgataacatgcatttcccctgacatctcccagcagtactcagcagcccccactgaccaggtccctggtgaccagatccagcatatcacttcctccctgaccacaccctcactgattagagccccatcaccaggcctcactaactagattcccgctgccaggcccacaatgaccaggactccactgacgaggaccttactgacaaggcctcactggcaaggcctcactgacgaggtccttactgacaaggcctcactgatcaggttccgccgatcatgacctcatcgtctggtcccacagacgaagccccactgaccaggcctgcagggaataggcagccagtgaccaggcccctgctaaccaggactgaggtgacaagatgcccctgactgggaccctaatgactacgccccactgaacaggcacacactgctcagatccccgctgaccaggtcaccccgtagaccagtgctacaaaagccaccaatgatcaagtcctctctgaccaggcccccactgattaagttccacggaccagcctgccctgaccagggccccactgacaagcgtctctgctgactcggtcccaaggtctccactgaccaagtcccacagcccagattggcactgaccagacaccaaacatttgtctaccactatcaacccactcaccaagacatacactactagatccctctaatgagacccgctctaagcagacccctgctgaccaccccccactaaataggcctcactgacaagtcccaactgactaggtccactgagcaggcccacactgatcaggcccctcctaaccatatcagaagaccaagaggcaatgagatgtttcatatggcaggagtaggagcaagacagagaggggaaagaggtgtgacatcctgttagacaaccagatcacatgagaactcactatcaggagatcagcatcaagaagactaaccaatggtgaaggattctccaaccacaccactgcccactgcttccaggcagaagcctcctgcagaggcagaacctcttatgaaacttccactatggcagcgcagaaagaaaatataggctttgagcccccacacaagaggccacgatcctccagactccagattaataagcccaccaacagctcacactctcagtatggaaaagctacaggcactcaacaccaacccagcccatgagatcagccatgggggctacaccctgcaaagccacaggtgcactctcctggtagaggtttcccatgagcctctgcctctgcagcaggttactcccaccttcccaccaccctactgacaacctactcctccccacactatccctccttttccttccaccccaaccccctcccatccaagattaagtcacctcccacctggcccacctccaacattaaggatgacatgtgagttttatagggacacacagccaactcatattattctgaccctgattccccagaacctcatgtccttctcacagagcaaaacacaatcatgccttttcaaaagtttctaaaagtcttaactcattccgaatgtaaaaatttcaaaatctcatctgagacaaggttacagtcccttctgccaatgagtccctgaatttaaaagggatttcttttccttcaaggtagaacaggtattggataaggtttctcaatccaaagggaagaagttgcccagaaaaataacacaaatgcaagtccaaaacccagcaagacagtattcactcaatctcacagctccaaaatcatcaagagaactcactgtcgtgcggacagcattaaggagatagagtttactcatttgtgaagaatctgccccccaccctcacctttcactccctcccacaaaataatctctcccattctccccacacccctacctccaacacccactcttctccatgattaaatcacctcccaccaggtcccacctttaacattccccactacaattccacatgaacattggtagggacacagaatcaaatcatattattctggctcttgctccccaaatcttgtatccttgtcacactgcaaaatacactgatgatttctctactgtcccccaatgacttaactcattccagcatttactgaaatgtacaaagacttacagaccccatgcaagtcaaaaacccagcaggccagtcattgaatcctacagctccaaatcatcttttctgaatctacatctcacatctagagcacaggtgtgtgatgcctgggcttccaaggccttgggtagctctgcacctgtggctgtgcagggtctataccccacagctgccctcatgggctgggctgatgttgagtgcctgtagcatttccatactaagggtgccagctgttggtgagtctatgaatctggagtctggagaacggtgcctccatatttagggactccagccctaaattctccttctgtactgccctagtaaaagtttcccatgaggctctgcctcttggaaaagattctgtgtgaacacccaggttcttccgtgcatactctggagtctagacaaaggcttgcaagcgtctagttttgtgctgtgtgcagctgctggcttaacactatgtggaaaccaccaagccttggagcttgcacccctgaagcagtgatgcaagcagtacctgtgcatctttcagccaaggctggagctggagcttcaggaatgcagccagcagtgtcctgaggttggacatagcagtggggccatggggctggagaaggaaaccattcttttctcccaggcctcagggcctgtgatagcaagggctgctgcaaaagtctctgaaatgccttcaagacctttttaatattgtattggctattagcactgaactcctttttatgcacatttctgaagactttttgaactttcccactgataatcagcttttctttttggccacttggccaggcttcaaattatccaaacttttaagctctccttctcatttaaatacaagtttcaccttgaggtcatttctttggtcacatataggaccacaggctgttcgacacagacaggaaacctcttaagctttgctgcctaaaatttcattccaccaaatacactctaaattatcaccctgatgttcaaaatttcacaggtctccaggttaggggcatcgtgcagcaacattctttgctaaggaaaaaacaaaagtgaccttgactcctgttcccagcaagctcctcattttcatgtgagaccttctaagcctggtgatcactgtccatccttctgtcacctttttaattataactatttaacaagtctctacactgatccaaacttttcctcatcttcctgtcttcttccaagacctccaaactctccaacctctggccattacacacttctcaacctgcttctacattttcagctacgtttgtcacagcctggcaatgtggtaaaagaagaaaagtccatttcaggagaaaaattaacgcaggcttcagacatttgcctgaaaagaagctgagtgctgattgccaagagaataggaaaaaggccttgaaggcatttcatagttccactttatggcattatttttctgtataatcagaaagaaaagaggttgaactggctcatggttctgcaagctttaaataaatcatagaggcttctgcttctgggaggactcaggaagcctcccaatcataccagaagaccaagcagcaatgggatgttttatatggcagaagtagaaacaaaacagagagaggaaaaaggtgccacacgttgtataaccctgttatacaaccagatttcctgagaactcactatcacaaggtcagtatcaagaagatgttgcttaatcattggtgaaagttctgccccctaccacccacacccctcactgtttccaggcagaagcctgaggaagaggcagagccactaggaaaacctctaatagggcagagcagaaaaagtatatgggcttggaggccccacacaggaggttaccatcctcagaccccagattcatagactcaccaacagcttgcactctcagtatggaaaagctacagccactcaataacagcccagcctatgaggtcagccatgggggctacacccagcaaagccataggtgcactgccctggtggaggttttccttgaggctttgcctctgcagcaggctactcccccttaatactgcccacgaacctctcaccaccctactgccagcctactcctccccatcctacccatttgttttcccttccacccctaccaacctcccgtttgtgattaaatcacctcccagcaggcccaacctacaactgtcaggaatacaattccccatgagtttttgtagggaaacacagccaaaccatattatcctgaccctgacacccccacatctcatgtccttctcacacagaaaaatacaaacatgccttttcaaaagtttcaaaaagtcttaactcattccagcagtaactcaaatgtagtaagttcaagtctcatccaagacaaggctacaatcccttctgcctatgagtccctgaatgtaaaagacaattcttttctttcaagttacaatgatggcacaggcactgggtaggctttcttaaaccaaagggaagggtttcctagaaaaataacacaaatgggacacaggcccaatccgactccaaaacccagcaggacagcattcatttatcacaagaactcactgtcacacagactgcattaaggagatagtatttaaccatttgtgaaggatctgacacccatccccatgtttcaccctcacccacaccatgaacctccattctcccacatcccccttccaacccccattctctaccatgattaaatcaccttctaccaagccccacacttaacattccccattataattccacatgagttttggtagggacacagagccaaatcgtattattctccctttggccccccaatctcacatccttctcatactgcaaaatacaatgatgcattctctacagtcccccaatgtctgaactcattccagcatttactcaaatgtccatttgtgaaggatctaccccctacccctgcctttcaccccaaccccaccacaatcgcccccaaccctccccaccccttaatccccccaaccctccccaccccccaaccatctaacctccactcttcaacatgattaactcaccttccaccagcccccacctttaacatttcccattaaaattctacatgagttttggtagagacagagccaaaacatattattctgtccctggtcccccaaagttcatgtctttctcacattgcaaaatgcaatgaggccttccctagagtcccccaaatcttaactcatcccagcatttactcaaatgtccaaaggccaaagtctcctctgagacaaggctgccatatcttctggcctgagcctctgaaatacaaagcaagttaaccacttccaagttacaatgattgtacaggcattgggtaagcattccaagccaaatagaagaaatttcccagaaagaagcacaaaacacagatgggacttacacaccccctgcaagtcaaaaacccagcaggccaggcattccatcatacagcttcaaatcatctttttggaatctatgtccacatccagagcacagggttttgtgatggctgggatcccaaggccttgggcagctctgcacatgtggcattgcagaatctcccccctacagctgccgtcattggctaggctggtgttgagtgcctgtagcttttcaacactaagggtgcaagcagctggtgggtctatgatactggggtctggaaaatggtgcctccctgtatggggactccaaccctatattttccttttgtactgcccgagtagaggtttaccatgaggctctgcctcttggaaaagcttctggctagacactcaggatttctgatatatactctggagtccagaccaaggctctgaagcttctagtcctgtgctttatgcacctgctggcttaacactatgtggaagccaccaaggcttggagcttgcatcctctgaagcagtgacgcaagctgtacctgtgcatctttcatctatggctggggctggaaaaggagctgcaaggatgcaggcagcagtgtcctgaggctgcacacagcagtggagccatggggctgggccaggaaactattcttttctcctaaaccccagggccagtgacagcaagggctgctacaaagatctctgaaacgccttcaaggcctttttcccattgtcttgaattattagcactgggctcctttttatgcaaatatccgaaggcttcttgattttccccctgaaaatcagcttttctttttgaccatttgtccagattacaaattttccaaatgttgaagctctgcttctcatttaaatataagttccaacttatggtaatttctttcatcacacataggagcacaggctgttcgacgtaggccggacaacccttcagctttgctgcttagaagttcattccaccagatacaccctaaatcatcaccctaaagttcagtttcacagatctccagggaatggtcactgtgtagccaattactttgctaaggcaaaagaaaaaaaccttgactccttttcccagtaagttcctcatcttcatctgagaccttacaagcctggccttcagtgtccatccttctgtcagccttttaatcataactatttaacaagtctctgcaatggtccaaactttccctcatcttgctatcttcttccaagctctccaaactctctaacctctggccattacccaatttggaacctgcttctacactgtcagctatctttgttgcagcctggcaatatggtaaaagaagaaaagtccattatcaggggaaacatcaagatggcctccaatatttgcattgaaaaaagctcagtgctaatagccaagagaatgggggaaacgcctagaagtcatttcataacttcacttcacagcattaattttctgtatctacataaagaaaagaggtctaattgactcacagttcttcaggctgtaaagaaagcatagtggtttctgcttgtaggaggactcagaaagcctcccaattataccagaaggccaagcggcaatgaaatatttcatatggcaggagtagaagcaagacagagagaggaaagaggtgagacaacctgttatacaactagatctcatgagagctcactatcaggagatcagcatcaagaagattgtgcttaactgttggtgaaggatctgcccacctccccatatccaccacccactgtttccaagcagaagcctgaggcagagacagatccccttggaaaacctctactagggcagtacagaaggaaaatatgggcttggagcccccacgcctccatcctccagacccaagagtcatggacttaccaacagctcacacccccagtatggaaaagcttcaggtactcaacaccagcccagcccatgagagcagcagcaggtgctaaaccctgcaaagccacaggtgcaaaaccacaggtgcactgccttagtagaggttttccatgagcctctgcctctgtggcagtctactcccttcctgctacacaccaccctacagccagcctactcctccccaccttacccacctgtttttacttccaaccccacccctctcccatccatgaataagtcacctctcaccaggccccacctgcaacattcgggattacaattacatgtgagtttaggtagggacacacagctaaaccatattattctgaccctgatcccccaaatatcctatccttctcacagagtaaaatataatcatgtcttttcaaaagttgccaaaagtcttaagtcatttcagcattaactcgaatgtaaaaagttccacgtctcacctgagaaaaggctacagtcccttttgcctataagtccctgaatttaaaagggagttcttttctttcaaggtacaatgatggtacaggcattgggtaagttttctcaatccaaagggtaggggtttgccaggaaaataacacaaatggaattacagggccaatgcaagtccaaaacccaggagacaagtatccattaaatctcacagctccaaaaccgtcacgagaactcactatcatgaggaaaggattaaggagatgctgtttaactatttgtgagggatcatacccccacccccacttttcacccctcaccgccagcataatccacccatcctccccaatctccatcttgcaacacccagtgccctccatgattaaatcaccttccacctggccccaattttaacatttctgattacaattccacatgagtttccatagcgacacacagccgaatcttattattctgtccctgcctccccaaatctcatgtccttctcactttgcaaaatacagtgatgccttacttacaattccccaagccactatgcttttttttacagcctgcagaaccatcagccgattaaacccctttttgttatgatcatacagaaaattagtactgtgaagtgaagctatgaaacgccttcaatgacttttccccatcgtcttggctaagacctccaaggtcttaactcattccagcatttacttcaatgtctgaagcccaaagtctcatctgagacaaagatgcagtcccttctgttcctgagcctctgaaatacaaagaaagttaactatttccaaggtatgattgtccaggcattgagtaagaattcccaccctaaaggaagatttttgccagagagaacaacgaaacacaaacgggacttacaggtcccaggaaaatccaaaacccagcaggccagttactcaaacttacagctccaaagtcatccttttttaatccttgtcccacatccagggcacaagggcatgagggctggactcccaaggccttgggcagatctgcacctgtgtctttgcagttttcagtccccacagctgtcctcatggcctgtgctggtgttgagtgcctgtagtttttacgcacagagtgtacaaagctcttggtgggtctatgaatctggggtctgcatatggtggcctccagtgtgggggctccaaccccatattttccttctgcactgccctagtagaggtttcccaggaggctctgcttttttggcagccttctgtctggacactcagacattttcatacatcttccaaaatctatatgaatactctgaagcctctgggctggtgctctatggacttgctggcttaagactatgtggaagccgtgaagccttatagcttgtaccctctgaagcagtgatgcaatctgtacctgtgcatctttcagccaaggtcggagcaggagctgcggctgctgggatgcaggcagcagtgtcctgaggctgcatacagcagcagggccatggggctggccccagaaaccattcttctctcctaggccccagggtctgtgacaccaagggctgctgcaaccatctctgaaatgcctccaaggcttttcccccccattgtcttggctattagcactggcctccattttatgcaaatttctggagccttcatgaattttccccctgaaaatcagcttttctttttgaccacttggccaggctgcaaatggttctaaacttttgatctctgcttgtcatttaaatataagttccaacttgaggtcatttcctcagtcacacataaccttggtcacacaagaacacgggctgtttgatgcagacaggattccccttgtgctatgctgcctagaagttcattccaccagatatgcactaaatcatcaccctcaagttcaaagtttcacagatctcgagggcaaggtcgccctgcagccatgttctttgctacagcaaaacaaaagtaaccttggctcctgttcccagtaatttcctcattttcatctgagaccttgtaagcctggccttcactgtccatccttctgccagccttttaatcacaactattcaacaagtgcctacgatggtccaaaatttctttcatcttcctgtcttctttcaagctctccaaactctccaacctctggctgttacccacttctgaacctgctttacgttttcagctatctttgttgcagcctgacaatgtagaagaaaaagaagtccattttcagggggaaacttcaagaaggcttcagatatttgcattaaaaagaagtccagtgctaatagccaagacgatggggaaatgtcattgaagatatttcatagctccacttcgcagtactttattttctgtatgatcataatgaaaaggggtttaattggttcatggttctgcaggctgtaaagaaagcatagtggcttctgcttctgggaggactcaggaagactcccaatcataccaataggaaaacagcaatgaaatatttcatatggcaggagtaggagcaaggctgagagaggaaagaggtgccactctgttatataaccagatctcatgagaactcactatcactaggtcagcatcaagaagatggtgcttaaccattggtgaaggatccaccccccaacacagctccacctcctagtgttccagacagaagcctgctgcagaggcagaggctcttgggaatcctgtactatggcagtgcagaaggaaaataagggctttgactgactatgcaggaggccaccatcctcgagaccccagattcatagacctaccaacagttcacaccctcagtatggaaaagtgataggctctcaacaccagcccagcccatgagagcagccatggaggctaaagcctgcaaagccacaggtgcactgccctggtagaagttttccatgagccttggcctctgcagcaggctactcccccttcctactatccatcaccctcccaccgccctacagccagcctattcttccccaccctacccaccccttttttcttccagccctacccctcccatccatgattaaataatctcccaccaggccccatctccaaaatttgggattacaattccacatgagtttttccaggggcacacagccaaatcatattatgctgaccttgaccccccaagtatcatatccttttcacagaataaaatacaatcatgccttttcaaaggtttccaaaaggcttaactccttcctgcattaactcaaatgtaaaaagttccaagtctcatctgagacaaggctacagtctcttctgcctatgagtccctgaagttaaaagggtgtttgtttctttcaaggtacaatgatggtacaggtactgggtaaactttctcaatccaaagggaagaaatttccaagaaaaataacacaaatgggaccacaggcccaatggacatccaaaatccagtatgtcagttttcattcaatctcacagctccaaaatcatgaagagaactcactatcagaaggacagcattaaggagatgatgtttaaccatttgtgaaggatccacccccacccctgcctttcacccccaaccccaccacaatctcctccaaccctccccacccccgattccctccaaccctctccaccccagaatcccccccaccctcccggtgcccccaaccatccaacctccactctccaccatgattaaatcaccttccatcagcccccacctttaacattttgcattaacattccacatgagctttggtagagacagagagccaaaacctattattctgtctctggtcccccaaagttcatgtctttctcacattgcaaaatgtaatgatgctttccctagagtctctcaaatcttaactcattccagcatttactcaaatgcacaaagcccagagtcttatctgagacaagtctacagtccctcctgcccatgagccagtgaattataaagcaagtttactacttccaaggtacaatgattgtacaggcagtgggtgactcataggatacataagtgtccaaaacccagcaggccagtcacttaatgctacagctccaaaatcgccatttttgaatccttgtcccatatccatggcacagggctgtgagggctgagctcccaaggccttgggcagatctgcacctgtggctttgcagcgttcagcctccgcggctgtctctcatggacagggctgttgttgagtgcccatagcttttccacactgagggtgcaagctgtttatgggtctatgaatctggggtttagagaatgatgcctccctgtgtgggggcttcaaccctataggtcccttctttgctcctctagtagaggttccccatgaagctctgcctcttggaaaagcttcttcctgaacatccaggattttctgtgcatcttctggagtctagacaggagttcccaagcctctaatctctttctctgtgcacctactggcttaacactatatggaaaccatcaagactttgagccacctctgaagcaatgacccaagctgtacctgtgcatctttcagccatggctggtgctggagctgcacggatgccggcagcagtgtcctgcggttgagcacagcagcagagccatgggactggcctaggaaaccattcttttctcctaggccccagggcctgtgacagcaagggctgctgcagacatctctaaaatgctttcaaggctggtttcccactgtcttggctttttgcactgggttcctttttatacaaataccctaagccttcttgaattttccccctcaaaatcggcttttctttttgaccacttagccaggctccaaattttccaaactttagatctccacttgaagttccaacttgaagtcacttcttaggtcacccataagaacacaagctgttcaatgtaggcaggacacctcttgtgctatgctgcctagatgttcatttcaccagatacatcctaaatcatcacccccaagttcatagtttcacagatctccagggcagggtccccatgcagccagcttctttgctaaggccaatcaaatgtaatcttgtctcttgttcataggaaattcctcattttcatctgagaacttttagttctggacttcagtgtttacacttttgtcagccttcctatcacaagtatttaacaattctctatagtggtccaatattttcctcatcttgctgtcttctaagctttcccaactcttctgacctctgtcttttacccacttctgaacctggttctacattgtcagctatctttatcacagcctggcaatgtggtaaaacagaaaagtccattttcaggaggaaagttcatgaaggattcagatatttgcatgaaaagaagctgagtgctggttgccaagacaaaggggaaagggccttgaaggcatttcatggctccacttcatagtactaattttctgcatgatcataaagaaaagaggtttaattggctcatggtccagcaggctgtaaaagaagcacagtggcttctgcttctgggaggatcagatcaggaagccttccaatcataccagaaggccaaggagcaatgagatgtttcaaatggcaggggtagaagaaatactgagagaggaaagaggtgccaccccctgttatataaccagatctcatgagaacacactatcatgaagacagcatcaagaagatgttgcctaaccattggtgaaggatctgcctcccacccgcaactcccactgtttccaggcagaagcctgctgcagatgaagcattcttgggaaacctctactagggcagtgcagaaagaaaatatggacttggagcccccatgcaggaggccaccaccctccagaccccagatacatagacccaccaacagctttcaccctccgtgtggaaaagctacaggcactcaacactagtccagtccatgagagcagccattggggctcaaacctgcaaagccacaggtgctcttccctagtagggattttccatgaggctctgcctctgcagcagtctactaccccttcctactacccaccaccctcccaccaccgtacagccagtctactccctcccaccctacccacccctttttcccttccacatccacccccacccatccatgattaaatcactccctcccactccctgtcataatctaatccctccaaacccttccaatctttgtttgctacccactactgagcctgcttctactttttcagaaatctgtatagcaggttggctatgtagcaataacaaaaatcccatttaaggggaaacattcaagaagatttcaaaaatttgcatataaagaagccctgtgctaatagccaaaacaaagggaaaaaggccttgaaggcatttcacagctcctctctgcagttctacttttctgtattattgtaaataaaagaggtgtaattgactcatggttctgcaagctgtgaaggaagtatagtgtcttctgtttctgggaggaatcaggaagcctcctcattatatcagaaagccaagtgacaatgagatgtctcctaaagcaggagcaggaggatgagatctgttaaacaaccagatctcatgggaactcactcattatcaggaggatagcatcaaggtgatggttctttatcatttgtgaagtatctacctgcaccattttatgactaaatctttttccacctagaccttgcctgtaacattacaaaatataattccacatgagttttggtagggacattgacaaaaaccgtattattctgtccttgacccgatgaatctcatgtccttctcacattgcaaaatacaaacatgtcttgccagcagtctcccaaagtcttaactcatttcaggattaactcaaagttacaaagtccaaagtctcatctgggtcaaggctacagtctcttttgcctatgagtctctgaaataaaaagcaggcattgtgtaagctttccatatccaaaaggaagacattttccagaaagcttcttatttctctctaagacctcctcagcctggccttcactgttcatgtttctgtcaggatttttgtcacaaccattgaaccagactctaagatagtccaaaagttttctcatctgtcttcttttgagccctacaaagtcttccaccctccgtccattacctggttccaaagctgcttccacatttccaagtatctttaaagcaacgctccagtcctcatttgccattttctgtatgatttattttgaaaaagaggtttaattggctcatggttctaagcacagtgcttctgcttctaggcctcagaaatctttcaataatcatggaaggcgaagaaagaatcaattgtctcacatggcaaggggaaaacacggagagtggggaggtgatatagagatttcagtgactacatctcatgagaagtcactcattattgtgaggatggtacaaggggagggtgctgaaccattcatgagaaatttgccttcataattcaatcaccttataccaggatccaccttccacattaggaaatataattcaacatgagattcggtggggacacatattcaaattgcatcatcaatctttgaatataaagacatccacagcaggctttatccagccaacttctttgagactctttatagagtttgaagtctagagcatatacactaaaatattcatacttcgaaaagcaataaagtggtattatcatttttccaaaagttacagcagtagtttaggcattcatagtatgatttagttcacgattgctactgtttctattctatcaccatattaactgtttcctatacaattctgtattcagctggatttcagttgagcacaaaaccatccttgtactagctctttgctagtgttattattctgctgtagaaagtatccttgaactggaaaccgtccacgatcgagtatcgaggcattcaacactatcaattcctgggtgactttttgaaaaagtagtatctcttgttgcaagaaatgctgcatctgtgagtccatgtctctcactggaattggatggaagtggtgaatttcagccaaagtggccaaagaaatcctgttcctgtgattctgacgtcatcagcctctgcacctctgtctttccttctgccacatgttgcctgctctccatgactttggtaagagcttccttgtgtatgtggatgatgtccaggatgttggtctggtgtccctgagacagcactaacaggtccatggctgggtccaggtccttcctggactgactggcaaagagctcactgacagagtgggaggcatctatactgaagtggatggcctggtccagctccaaggcctggctgaggctgaagaagaactgtcaggcttctgatgctctttctcaaagcctgccaccactcattggctgtgaagttgagctgagtgccctgttgtccatcttcttggtgaagcacttgaagccgtcaatcttgctcttccactcctaaaagttgagtgtcacactgggggtgggctcagggccaggaagaatctggcactcaccatctcatccttctcagccttcctcttgccctgtctccaggctatctcttcagtgctggtggggcacatcaggaagtgacaaaaaatgtggcactgcacctgcatccagaagctggctgtgtggttcatctacaagattgggccctttctgcacttgaacatagatccacttcaccatagatgccttccacactgtcagtgagctctttgcccatcagcccaggcaggatctggacccagtcatggacctgttagtgctgtctcagggacaccaggccaacattctggacatcatccacatacacaaggaagctcttaccagagtcctcctcaagatggcctgtggtctgcctcttggcacccgagaagcccacagtgctgtagaagccccgatgcttggactagagccccaaaggcggcacacaccccagttctgagcctgctgctcatttcctctatgtggctccatttgcagcacatttgttgcactgaggcctgtgcatgccaggcaaagccaagctggctcaaagagcaaccacccacctctgcaagggtgtgccaggagccagtggaccagccaccaacgtgactctctgccagtcagggtaaatcattttttctgccctggaggtggagccccagtgccatctgcttttcctcaggcctgcactccatcagctgtcaggtggtggtcactcagactgtggtaaactggccatccctatttccttgagtgggtgaggttggtgactgctccatctgctcctggcacacccttgcagaggtggctggttgctctttgagccagcttggccttgcctggcatgcacaggccccaggtactgagaagctgctccgagtaagtttgtcttgggccaaattctaagtctggccagggccacagaaggccgagtcccatgggtggtaatcctggctgctgcaggggggcccatggtgcccctcccctcccagggctcaggatgaggtccgactgggacaggatgctttaggtatgggacttgtgccccaggaggggacctctgtcacacacgttgggtgagaatatgtatggcatgctgctggctgccagggctgttaggatgcacgttcacccttaccttcagggacctcaaagtgaccagcttccgctttatgaatgacttcccaaggcccaggagccatttggggctgcagagcagctggctgctagctgccctggcttcttccatgtagtgctggtcactacctaccaaggggggtcagatgcaggcacaatgtaggatgattgtctctggacctgtgtcttggttatcatggagctagactgggcctggtgacagggccctgatggggttgtcctgtgtggtcacggaggtgatcagaaaagatgcagaatggaattgctgcgaggatgaatgagatgactgtcagcacataacaggcagctggtgagtgttcagggattaccctcagtagctgcccagaggccaaaaccatccacctgatagtgacttttcccaaaccaggaggaagagaaaagagcaggtcccactcacctgaatctgatcagtgagctgtgttgagatgtgcctctcatctagaaaatggtccttcacgcagagctactcacagacactgctgtgtgtctctaactgctccacaacacagaggcgatggggactcagcaacagtgacattgtggggtgacacaacccacaaccatgggagtctgcttgggtcaacagggcccagagtcagtgtcctctatcccctgaactgacatgtgtgtatgcaatgtatttgtgtatgcatgtgtgcctgtgtgtgtgtgtgtgtgtgtgtgtgtgtgtgtgtgtatgtgtcttgcttctctggacaggcctagcttctccactcatgggtgcacccaggtcctcatcactgtcaccttagagcattagagcctctatagttgctccccaatctctaccctccccacccatggtggtcctggggatgcagacagaggaggggcactgcataatgctgagaggcctggcaccctctctaggtggaacacaggtcatttgtaaagttgtaggtctgccaagcagtattggattcaacacatcttctcaccttctctttccagccaccctccagggtgccccaactcactttccctgcagatggaggcaaggagcctccacagacaacccccctgcctgaggtcacatagtggccagcaggccagttactgaccaactgcccctgaccaggttcccagtgatgagtgatgaggcccctaatgaccactcctccattgaccaggtcccactgatcaagtccccactgaccatgtcttcctaaccaggcccacacttaataggcctcatgggccagaccccactgaccaattttccactgacctggtccccattgacaagaccgggttcccactgacaagaccacaatttaccaggttgctgctcacccgaccccccactgaacaattctccatgaacgagtacccagctgaccgagccccctctgaccaggccctcactgaccagcctccaagccactaaggccccacactgaccaggccagtgatatattgtgtatgccccaccaaccagtttttcattgtttatgttccaacagatcaggccccactaataaagccaccactgactaggttcccccactgaccaggcttcctatggctaggtcaccaggtccccactgatgaggcctttactgaggaggccgccactaaccaggcccctgctgatcaggtcccaaatgactaggtcctgatgaccaggtcatctctgaccatggtccactgaccaggccccggagcaacggggctcaaagtctcattacaatgtccccctcagctcatagaccctccctccctgcatgtgtgcccagaggtcaggccctgggggtttttttgggacatggcctttcctccaagacacagggagagacagttggcctcaggctccaggttcccagctccacactcaccccaaaggccctctgggcccgtctcaaaggagaaagtgagatggcctgacactgcctggacacaccatctaccctattcctgagtgtcagagtgtgaggaagggagggacatttagcagataaggcacgctgtgctgttgggtctctcagggcccttcccacagagccccgatctaaagacacaacacagaggctacaggaagactaatccagaacctctgagacagccagggaccacatgaggactctccccagacagccagaaggccctttgctagtttcttggtacctcagtggatgtggcagtggttcttctgttggggaccagtgagtacacactggggagggctcacctgtgcttcctcagtggctccacctctgcttctaaaaaaaattactcattccagagctagcgcagagaaaatacaagctgagcttagaacatcttctgccacaaagtaaaaaagtgccgacagagtaatggagacaaatcaaagagacataaagtcagcttggaatgtctactactggcctaatcttggggaattggagcatcagaatcatgagctttccttctcccttatttattggttttatttctccatgtagaacaaagaagataataagaaaataatcatctggtaaccatcatagtaataattgttcaaacacaagtcatccatgaaatgctaaatctagtgggttctgaggagtaaccagatatttacagagcctcaaagtatctccatacaaaatacggttgaactactaaaagaaaattgtaacattagcatggacaaacctggtaggtactccttaagtctcctaagtaataaaaactgtaaaatgcaaataagccttcgatgacctttactaacctttactaaagtatcaatgatgacttggttgtttaaacagctgacatttgggcaatttgagtatgtcaaactcaataatactggttttcatttgcaagatccacttaaaacttaaggaggccaaaaaacatcatttaaaataccctataaattataatcatacatatgatacaaaaatatcctacttcagtaaatattggaatgttatatattttatgagaaacaattaaaatgtgtaaatagcccagtgataaagttttataatcttttaaatcatcatacaatttttccttaagactttatggttaaatattctcttcattagatgtggcttacccgtggattccagagaagaaagtagatgggagcaagtgtccaatacagcaacagctggaaagaaaaataaagaattttgttctttacctaaaacacttcagttaactaagtgtgagtttaaaaactaaagacttgagaactttatcagagttaataagaacgagaaatatgtatgtacatttacaatacaaaattactatttaataatttacacatggcattaattctaattgtgtttaaatatcagagctttttcaggcttcattcatgtaatcaacagccacatgctaaggtactcgaaccagcagtggaattacaagatgaagatggcatggtccacctctcaacagtcataagctataatctaaaaaacagacaggcaggcaatgtctatatagagtcatatataccatgacagatatagagcagggcactactggaacacagagaagggacatctacccacttttatgtcaatatcatgggctttctggtggaggagataacataggttgatacctgaaggacaaggaaaagcttcccagatagaggaaagaggcaaaggcaaagagcctgaggtaaggaagagccctgcagagttccactccatccagtttggtgctagagcaaagggcagagtgcagtaagcggtgagaaacaagactgagtaacttgacaagaatcacattgacatgggtgtttttatttcatggtgaaaaatttggaacttttcctgagaacaagtgtaagccaatgacacagttaattagaggagatttaaaatgtcacctgtcaagtgactgcttatgaagggttattgctcagctaagtatttctgaatgagtcttaggtctgttggccttcaatctctaccaaaaccctgagaacttgatgatgcttttgttttctgagaatcgtttcagtgtgctggctgacagttccatgaggatggcaaaacttaagaaagtgtagagccaatgaaaaagagatgcacagacatcttgggaactgtttaagctttggaacatgatgaatttatggtgcataagtacagtcttctctgtgaaagtttttgttttcacatctttcattagatgtgtgtaagaaaaaaaatattgatgtagtatctactaacccaagaatgaaaaggaatgccatttgctatttacactttatttctaaaataaacctaaatttaattaataaattttgtcatcgtacttctctttgtttctctaattatttattctacacagtccggccccatctaaaataagtaaaaataatagtaatgtctaaattaaacaagaaacattatcatgaaaatcatgtatcacttacaaaatgtggcctttagtatttttagtgactagacataacttgaagtttgcttaaatagaaaaataatcacataaataaaataaaatttctacttattttaagtttagataacagaggatgtatatgtgtaatgctgtttagagtaatctgacaaaaatgcagttaacactaatctattgcatatacatgattttagaaaggtagtgttttattagtacaaaggttaaacaatggccaggcatggtggctcatacctgtaatcccagcacttggggaggccaaagcaagcagatcacaaggtcaggagatcgtgaccatcctggccaacatggggaaaccccatctctactaaaaatacaaaaattagctgggcgtggtgatgtgcacctgtagtcccagctacttgggatactaaggcaggagaattgcttgaagccaggaggtggaggttgcagtgagccaagactgcatcactgcactccagcctggtgacagagtgagaccctgtctcacaaaaaaaaaaaaaaaaaaaaaaaaagattaagtaattaaagccatcttttgcaatgaatgcattgctttgaaattcttagaaaagtctgccctttataaaagtttaatccattttttacttcaataaattttatcttaaaaagaaatttctgttctctacttatagtaaacttttctttttttttctagtttgtattctaaattaacgtggtacctctgtaagtttcttccaaaggcatattgagggataccgaggtttgcagtacaattaaacccatcacacaggttgtgagcataggacccaagaagtagtttttcaaccctggcccactctgtccctccccgttcttatttcccagtgtctattattcccacctttatgacaatgtgcacccaatatgtagctcccacatgagtgaaaacatgagatatttggtttctgtttctgcgttggtttgcttaggagagtggattccagctgtattcatgttgctgcaaatgacgtgattttgttcttttcatggctgcatagtattccatggtatatatagaattttccaatctaccttggattttcaatctaccttggatgtacctggattgactccacatctttgctattgtgaatagtgctgcaatgaacatacatgtgtatacatctttttgttacaatgatttattgtcctttcggtatacccctagtatagtaatggggttgctgcatccaacagtcattcttagttcttaatttccaaactgctgtccatagtagctgaattaatttacattgccacaaacggtttgtgttcccttttctccacagcctatcccaatatccttttttaagtttttatttattatttgtttttaacaaaagtcattgtgactggtgtgaaatggtatctcattgatgttttgtttggcatttttctgatgattagcaatggtaagcatttgttaatgtttgttggccacttacgtgtgttattttgagaactgtctgttcatgtcctttgcccatttttaatggtcttaattatttttggcttgttgatttgtttaggtctcttatggattctggataataggcatttgctatatccatactttgtgaatattttcttccattcttttaggctgtctgtttaatcccgtgatagtttctcatgctgtgcagaagctatttagctaaattagatcacacttgtcaatttttgttattcttgcaattgcttttgaggacttagccataaattaattgacaaatatgatctccagaagagtatttcctaggttttcttccaggatttttatagtcagaagatgtactcttatgtaaggaaagcacaaaccttttttttgttttgttttgagacagagtctccatcaccaaggctatagtgcagtggtatgatcttggcttactgcaacctctgtctcctgggttcaagtgattctcctgcctcagcctcctgagtatctgagattacacatgcctgccaacacgccttgctaatttttgtatttttactagagacagggttcatcatgttggccaggctggtctcaaactcctgacgtcaggtgattcacctgcctcggcctccccaaattttgggattacaagtgtgagccaccatgcctggccaagcacaaagcttttaacataaaaatggaaatgaacattttagtgttttgtttaattcataaaatgcaattattttggattctactaaataataaacatccatatgtggcaaagtgtttggatgccaatcattcagttgtgattatgggtgggaagaattgagatggtgcaaataaacttttttaatttttttttttattttcaagatggagtcttgccctgtcacccaggctggagtgcagtggtgcaatctcagctcctgcaacctccgtctcccaggttcaagcaattctctgcctcagccttcctagtagctgggattacaggtgcccaccaccacaccaggctaattttttttttgtacttttagtagagatggggtttcaccatcttggccaggctggtcttgaactcctgacctcgtgatacacctgcctcagcctcccaaagtgctgggattacaggaatgagccaccacacctggctggtgcaaagaaactttaaaagtggcatgggccgggtgcggtggctcatgcctgtaatcccagcactttgagaggctcaggcaggcagatcacaaggtcaggagttcaagaagagcctggccaatatggtgaaaccctgtctctactaaaaatgcaaacattagctgggtgtaatggtgggtggttgtagtctcagctactcaggaggctgaggcaggagaatcacttgaacccgggaggtggaggttgcagtgagtggagatggcaccaagacactccagcctggatgacagagtgagacactgcctcaaaaaaaaaagaaaaaaaatgtggtatgaaccacagctaaactacaatcaattagagagtaagccaaagcatctcaaagtatatcatcagttatcaggcaataacatgcaatttctaaaacctaacttaaatgcagcttttaaagacatttcaaacgtgtcagtttagtcacatttattgaataaagttagcaaatggatatctcttgaaaatgagagctccagggaattaaaaaatgtaaagttcccatttcctttctgtgttaacacagctaattatgatctttacttcacatgcaaaagtcaacagaacaactcagtatttcaccaaattataaacaagaattacgctagagaaatgaaaccctaaagagaaacggtcatataactaacctcagtcaagtagttctggcagttatttgaagtctgaggtttgaagtaggaattcttacgggcatttggggaatatattttctgttgagtcctatactagtaagattttcaacacaaggtgactctcgacctcgccttgtaggaagagtgctgagaaaatatttcacctgctctttctccataaagagctgatactgatcattgctattttcttattcgatctgtaaagatagcaaagacaaatgtttaatatttcatttttccttaaatgattcttaatgacttgaagtttttaaaaacttaccctgagagtaaaccaaattacccactaaatagtgttttcacatagaagatgtgtaagagcatacctgttgtaaggaattataattttaaaatcgttctaaagaatcaccattgtttctaaggtgatttctactgaacaagcagttcaaacaaagtagacagggaagagaaatggctatcagtgatttatggctcaacaggtaaaacttcctgccttctaaaatggttctacttgtaagattctgaagattcaattagaaatacttgtatttaaagggtaataatgtgggaaaatgaatatgttgatttgcttgattataagaaccacttcactagaaataattatatcaaaacatcatgttatactccttaatgtaggttaagaaaactaaaatgaacgaaaaaaaatctaggaatacttgtgtttagtaaaccagttttagatttcacttttgtacatttcacccattatctaggaccaattaaacatttggcactgaggaataattcagagcaacaactcctaggggagaactagattgtctggttggtgatcaaaaagaactaaagcatctctgaaggcaattagtccccaacactgtgaccaaggccctggaggtggggcatgttctttctgccttccacacaccgcttcaggctgaacaaggtgttattttttaaccgctttgtgaattacacttctttaaattcctgtgataattattccctatttcacaagggtgcctttctgcagcatcttgaatatgttacacaaatagtctttcttgaggcaccctctggtgataatactaaagatcacaatcaaaaacaattgtgcccagagtagcagtaccactttgcatttaggttgtgatccactgaaaagtaaattaaacacattaatatttctatttagggaaattctgacaagtaattttataacaagatcacttcattaattataaagcttcaaaaatacttagtgaaaaaaactaacagatcaggttaattacatgagacttttcaggaaaaaaagccatacaaaagcaaaaaaaaaaatgagaggagagacaaaaactatctttgactaacattttaaaggtaaaattatttactcacattatttttcaaaattacattgtcaaattagcattcacttgcttctaatctcctgaagccatctcactaaaaattatgcttttgaaacaaattaatgagcttaattcattttctatgagtgtatgttttgacttacttagttaatttttttgacatggaactattagctttcaatgctgctgcaaaggcttccttatattcttctaactcagttgtaacctcttcataagcagttttcattttgtagaatttacattccacatctttaagtgtgagttccttcttatttagtgaagctgtattatatccttgtttaactgctctaattgttttttatgttctgcttgttcctaaaacagaggaaaagaatacacttttaaaacaattataacctaattattatgtttgttgcctttcattttgagtcagtgattcaaagagtatttttgaatatgttaaaaaagaggatgaagtttaaaatatttcagcaatatcaaaactaataactgaattcagaattaagtctgatttgtaaaaatttgaaatcataattatgctagtattaatgtaatctggtcatataaaaagtaatagaatccattcatagttttaaaaagtgatcaatgaacactgtagcttaagaccaattcataattatcacataatttctaaatcacaattttttcctatgccaactggtcttaatcatcaaatgactccataatgagaatcattactctgaaagattgattttgttataataataatggaaatttaaatatttaaaagaaaaaacagataccatttttttctagaactctacaaagcagattgctacaagagaggcagaggaaacactatatatatatatatatatatatatatatatatatatatatatatatatccaaaatataatttgcagtgaaataaatgaaagcacattacaagtaaacttacctgatttaaacaactcacctgtaaatggatttcttctaatttttctactgcctgcattgccctttcatctagctctgatttatattcttgtagtttactaagttctaccatactgttttccatatgtgtcttaagatttaatatttcttcttccaacatctttttatcctcctcaagtttttcacattcctgttgtacttttttcatagataataactcctgttgaaaaacttgaatctctttagccaaattgacacattttgaagatacagcttccttctccgccataaaatcatcaaactgcatgaataaaatagtatagcttgataatgaagtaggctgagaataatcgaatacaaaaccaatagcaaattatgaaatgcatttacttgcaataaaatgttatctgtaatgcagcagattcttcaaatgtgaacccttaaattactcagaattttaagaacaaagttaaagctaccatgagtcataaaaatatattctttactatcatcatctttgccacagaatttttgtacttcattttacttttatttttctgataattcatttttgttcctccttaaatggcacaaagttatctcctagtaaaaagtgtctaacccccttccttcattatcattccccacagtatgtcaaaaaaagtttcagagatatcatattgagttatttaggccaaagtcaataaatgggtctaggaataagactttgaaaatgatattacactctatattaggtatggtggctcatgcctgtaatcctagcactttaaaaagctgtggcagaaagatcacttgaggccaggaattcgagatcagccagagcaacatagtgagacccccatctctacaaaaaaaaatttttttaattacccgggcatggtggctcatgcctgtagacccagctagttgggatactgaggcaaaaggatggcttgtacccagagttcagggctgcagtgaattattatcactgcacttctgcctggatgacagacaaagaacctatctcaaaaaaaaccacaaaataatgaaatctatgattaaggattctgatgctataagcctttccttaaactgcaaatgtttcatgctaatttgaattgcattttaagaagtaatgtttcttggggtaaagaccatagaatacggcacccagaaataaatccacatatttccagccaactgattttggacgaacatgccaagaacatacgctggggaaaggacagcctcttcaaatgaatgacactgggaaaactaaatatccatatggagaagaatgatattagcttcctatgtaacaccatataacaacataaactcagaatcgattgaagactgaaatgtaaggcccaaaattatcaaactactctaagtaaatatagggaaaatgcttgaggacattagtctgcacaaagatttttatgggtaagacatcagaagcataggcaaacaacaaatcatagacaaaagacactacattaagctaaagagtttctgtccagcacacaacagagtgaagagaaaacctgtagaataggagaaaatattgtcaagctattcacctaataagggactaatatacaaaatatacaaaaaaactcaaacaacttcacagtaaaaaaaaatctgagtttaaaattgggcaaaatatctaactatactttttttagaaaaagaaatacaaatagccaataaataaattttaaaatgctcagtatcactaatcctcagggaaatacaaatcaaatctacaatgtgatataatcttgcttcaatttgaataaattgctgtcattgaaaagacaaaaaaaataacaaatgctggtgaggctccagagaacagtaaactcttacatgctgttggtgggaaggtaaattagtgcagccactatagagaacaacaggaggttttctcaaaaaaactaataatgggactgccgagggatccagcaaccccactaccgggtattcaggcaatagaaaagaaaacaatagatcaaaaggatatctgtcctcatatgtttactgtagcactatccacaacagcttctgtatggaatcaacctacatgtccatcaccaaatgaatggacgaaaaactgtggcacacaaacacagtggaatactattcaccgtataaaggaattaaatcctgttattcgtggccaagtggatcagtctgacggatgttatgttaagtgcagacacagaaagataaatactgcacattcttactcatgtaagggagctaaaggaaaattgaaggctgggaaatatggctgatgcctgtaattttctagctctttgtaagaccaaggcaagagaatcatttgaggccaaaagttccagagctccctgggcaacatagggagatatctctacaaagtcaaaaatcagacatgtgcaatggtgcatgcccataatgccagctgctcaggaggctgaggtgtgaggatcagatgggcccaagagtttgaagctgcagtgaactatgatcaaaccactgtctccagtctcggtgactacagttgcccagagcccagactacactagcaagaccctgtctcttaacaaaaaaaagctcacagaagtaggggaggggaggctggttaatggatacagaattacagttagataagaggagtgagttctggtgttctgtggcattgtagggtgaatatggttaactatgacttattgtatatttttaaaaagccagaaaattttcaatgttcacaattcaaagaaatgaaaaatggttgaagtagtaaatgtgctagttagtttgatcattacacactatatacgtgtataaaaatatcactctatagcccataattatgtatatatgtgtcaattaaaacaaaagagaagctacattcatcccatttaaaaaacagaatatgggccagccttactgacttccttctaatgagttgaatgtagtgaaagggataccatgtggcttccctatctcagactgttttcccttggagcccagccccaattgtgagagcctgaaagtgcctgtgttagtgttcatgctgcctgtcccaaccaagtttacagccgatggccagcatcaaccatcaaacaagtgggtgaccaaagcttcagaggattccatttccccaactgatcagctgttcctagggaagctgaagggagcagagacaagctgtcctggccaagtttttcccaaaccacaggttcatgaacaaaataaatgtttttccttcaaaccacaagactctgggtaattgttaggaaaataagttttaaaaagagacaacaggaaacataacttatgcagcagaaaagagtctcctttaaagcaggatctaaaaaatgttgatatttatttaatgatgtcaaacattattgagaagcagtagataaccaggagagagacataagctgctgaggaggaattttcctaaaactccttcaattatgaactctgataacaagacaagggtgtcttcttacaatttctcctcaagttaggaagtaagactgggaagcaagaagatgtatgatttgaaaaacaactagaaatactgggtgacataggcaaaatcagacatttacctgatttcaattaactaaaattctaaaagaagaagttttgagtatttattaatcaacctagtattcaattttcattttcttttctaaatgaggaaataaggagaatattatggaatgatttttattcttcacagaagtaaaataagcataatgtattttgagtgttaagacacaaatgcaatttctcctttaccttactccaagcttgtttgtatggagaagttaagaccatcccatctctttgttatgccacaatgcttctctatagcacacaacttggctctgaaattttgaaagtcaaaatactaatctactatgtgtctctgataaattgcctgaacgttacctgattttgaagtgctgcactcctaagactttttcttggaatgagttaaacgttttattccaagaatcctctactgagctagaaagcagagctgtgcatctctgtttcagtaaaaggaggtcaatacagggaactgtggtttctgagaatgcaagatctgcactaagaaaaggattagccacagtgctacccaagagaaccagctaccaggaggaaagagggtctgtaaactgcaagatgatgacttcacttgatttccactgaggaaagctggtggctcagacttaaacttccccttcctagatggtaaacatctatggaaggttctatgaattataatgagttagtaaaacataatgcactgaatattagactatgtcagcagatcctgtaacaaaaacttactgaaaatataactatagtgggaggcaatggaaaagagactaaaggcttgaatggagaaaaaaagaaattaagtgtgtcttgtaagcctggtgtctgatcatgtcttagaggaagtaaggtataagctggccagagactcctttgtgacacaaaaggtgaagttacagacattccactaaatttaatttttattatgacataagacaactggtaatatgcaacatgattgaaaaaaacttctcattcaattcgattgggccttgacataagaatagacataaaaaagctaagaattgacaatctaaaaataagcctgcacttttacagtcacttgattttatacaagcttaacaaaagaacaaaatgggaaaagaatagtcttttcaacaaatggtgctgggacaactgggtatccataagcaaaaaataaataaagtttgaccaaatatcttatttaataattaactcaaaataaaatagttaactgtaaaagctaaaactataaaaccctcagaagaaaacactggcataaatctttgtgacagcatttgccagttttttcttagctatgactccaaaggaaaaatggattcaatggacttcaaaattgaaaactgctgtgcctcagaagacagtatgaagaagtgaaaaggtaagacgccaagtagaagaaagtatttgaaaagcgtgtatctgataagggacttacatatataggaaatataaataactcttgcaattaataaataacaagataagccaatttttaaaaatgggcaaagattttgaatagatatatctgcaaagaagatataaagatggataagcacattaatagatgcttaatgtaattagtcattaggaaaatgtaaatcaaaaccacatgtggtatcacttcacaccacaggataaaatctttgttcaagaaaaaagagtgttaggaaaaatgtaaagaaattaaaacccttatctaatgctgctgggaatgtaaagtgatgcagccactttggaaaacaaactggcagctccttaaagggttaagcatgaagttaccatatgacacagaaattccagtcataagtatatactccagaaaaataaaaacatacccaagcacaaaaactcatacataaatgtttacagcagcattattaatagtagtcaaaaggtggaaagaaccagaaggtctgtcacctttgggtgggagagaacccaaaggtccatcacctggcgaatggataaataaaatgtttgatgtatccatacaatggaatattactcagcaataagaagaaattaagtacagataccgtattaggaggagacagcaaaatgcctaggcagatacggaagggtccctggagaatctccaaccagccccacaagtgtttacaccagatgttatgtgcagataagggaacctggacttgtcttgcctggacatgcccacagcagaccggaggccaacatgcagtggggggatggggtggagtcaccaggaattcacgccttatgcagaggaggagcctggccgcttcagctcatgtgatcctggtattcaattgtgaggtggaaacctctttgcaggacccctctctttgctgagagctgtcctttcacataataaattctgccctcctcaatgtgtctgcatgcttaatttttcctggtcacgagagaagaacccagatgtagctgaactaaggagcaaaaacccggcatcaatacctgctacagcacagatgcagcatgaaaaattatgctaagtgaaataagccagtcccagcagaccacttgctttttatttcagaggcttataggcaaatctatacaaagaaggtgggtggttccctagggctgagggaggaagggaaaactagtgaagatggctaaatgctgtggggtttgtttttagggtgatgaaaatgttctaaaattaattgtaatgatgacggcataactctctgaaaatgctaaagttaatgaattctatactttaaatgagtgaattgcatggtgtgttcattatttctcaataaacctgttaccccccaccccaaattaatttggtactagagatctggagataggtactgcttggtttcaaatcactggccagggttcaaggtctaagagaatcaacaacatgtcccttttatagaaaaagagatttatattttacaagctatccttttcattagtatcaagtctgtaaacttaaatgaaaaatctttctttcactgcttaaagcactgacagatttatatagaggaataagaccttgttttctttggccccaatttctatctaaagggtctgggaaacacacccttcaaattatcaaatctcatcagatgggttttattaacacttataatgtggcttccttgctaatctgattctggtgcagcatcacagagagaagaagctgaaggaaatcaaaatattttacccccaaatatatttttgatgtattttgaaatggctgctgcagggccaagagattgaaatgaccctcattaaggtagcccaatctctccccttctaggtcttcccagatctggggaagattaactaagagcctgaggcatttaaagtttgaaaagatatatttaccctctattttctcaacatattttggcagaatttggatttttccattatcaatattttccaaaatgcatgatttttaataccaaaactgatttaaaattaccatacgttggaatataaattattctattataaagatacatgcatttgcatgttcactgcagcactattcacaatagtaaagacatggaatcaacccagatggacattatcagtgataatgggataaagaaaatgtggtatatatacaccatggaatactatggagccataaaaatgaatgagatcatgctctttgcaggagatatggatgaacccgaagctgatatcttcagcaaactaatgcaggaagaaaaaaccaaacactgcatcttctcacttataagtgggagctgaacgataagaacacatggactcggggaggggaacaacaaacactggggcctgttggggtcaggagggagagcatcaagatcaataactaatgcccacagggcttaatatctaggtgatggattgataggtgcagcaaaccatcatggaacacgtttacctatataagaaacttgttggccagactggtcttgaactcctgacctcatgatcttcctgccttggcctcccaaagtgctgggattacaggtgtggccaccatgcctggtggctatttctctttttaaattctctcaggattcctaaaatctcaaaactttgacctagattccctaatctacatttccagctctgaccattttcttgaggtctcttccttctagtacacatattatagaaaatattctcaaccacatgctcatacattgctaattggtgcagattacttttgtagatagtgaatgttgtctattttatgttggttctcattaatgttactttgagtatactattattttctaatctcaaagggggactatctcactgttatgatagtaaccagtatactttgtccttttttccttgctttcttcttttttggaccagtatactttgtcccttttttgtttttctttttttcttttttttgagatggagtcacactgtgtcatccaggctggagtgcagtggcaccatctcggcttactgcaacttccacctcctgggttcaagtgattctcctgcctcggcctcccaagtagctgggactacaggtgtacacaaccacacctggctaatttttgtattttcagtagagacagggtttcactatgttggccaggctgtttttgaactgctgacctcaggtaatccacgtacctcagcctcccaaagtgttgggattacagacgtgagccatggcacccagccctctttttcttttatgatgaaaactttcccatgagaatcatattatcaattgtttgcctttgttttcttttaaagaaattccttttccatagagatatggcatgatgaaagtcttgttctaaagtttattttgggggacacttaactatgtcattgggaagcttcagtaagtagagatctcccttcttctcactcaagattcttcgtctcaaaatggggtccaccaaatgtcttaatccaggtagtcccttgtttagaaattcatgaaataagaaccttctcgagaagttggaggctattgattgagatggtttaacgctgccccttattatatgttttactcccaaggtagacatcaaagtggctaataattctatgactgatgtctaactcacttctatgggaatctatacaaaacgttttatttatgagacagagtctccctctgttacccagcctggagcacagtggcttgatcactgttcactgcagcctcaatattccaagcttaaacgaccctcctaccacagcctcccaatgtagctgggactacaggcgtgcaccaccatgcctcagataagtgtttaattttttttttttttttttgagacagggtctcactatattgctctggctggtctcatactcatgggctcaaacgatcctcctgcttcagccttccaaaaccaggtgtttaactggggactaacacgaaacacttagaagactacgtggaacatagtgagctacataaaatatttgctattagcataataattttattgtatatcttaacaaaattgtgtattttaggcaggtggcatgccaatgaaagtactctcctatagctgcactgaatcattcttaccactgagagttgcagcaaatgggggacataatttataacttacttttctctctgtatgactcattaggcaatgactatgtatgtactacaatgtaaacagcacctcctggattgaatagtacataactgacatgaccagcagagacaggctaaagacactgagctgaaaaccctggactctattgttaaatcaaggctcctgaatccgttccctctgagcaactgttgctgtggtgctgccttcacaatcactctgctgagcactcagattgaggtgctgtgctatccgtcatcggacaagctgcacccagaactgttcagctgacaaactggtagcagtccagaaatacagttctgctgcatagtgaaaaaaggccaatttagattctttttcatagagagaaaaacataaatatgtgatttaacaagtctcctgtattaaactaattggtttagatttgatatataattgctaaaaacacacttagaatataaaccttactgtgtcaaggtctcaaagaagaaataattggtatggtataaagtattgaattgtatgctacaaacttctaagctaaaatactttcaatgtatgcaaggataggtggcatacatattatatattattcccccattaagcaaatttataatgagagaaaattatcttccataaaaaaagccatgtaaaattaagaactaagtttttctgcacagactagacaatgattgctaacacataaggtcaatgagagaacagtcagagaaagcttcatgaaaacaataaattgtctgccacgtctgagtgaatgaggctagatgaacagaaactgagaacgtagaaagaatagcatgagcaagataagtgctgaaatctgcccaattaactctgaggataaagtccaatggcagagaaataaaaacccgtgtccacataataacctgtaagtgaatgttcacagcagcatttttcataagagctaaaaagtggaaactaacctaaaggtccatcaactgatgaatgaatggaaaaccagtatagccatggaatagaatatcatttaactataagaagaaataaactaccaatgtgtgctaaaacattatgctaaatgaattctgaaaacattatgctaagtgaaaaagccagtcacaaaggactacgtattgtataactctatgtatatgaaataagcagaacaggcaaacatatggagacaaaagtagatagatggtggttgcctacaacagaggtaggtggagggacatggaggaaggctgcagtcatgcctaggagatgtggggttgcttttcagggtgatgaaaatgctgtgaatatactaatagatactgagttgtacattttaaatggttgaactctctgaaatgtgaatgttatctcagtgaaattgtttttaaaatccaaaggcaggatcaagataattttctcaactctcaatttttgatgtacatgttatctcaaatttaaatatttccacagttttatagtatattttaaataaaagataaagaaaatacctaacttttcaaatagtttgcaaattaacctaaaacatgcacttttaaaagaatagtataatgacctttctgtacaagttaacctagaatctgtgaaataaatagacacagattctgtgtccactcacaaaagtgaagaaataagacaattttctggaacattccatgaaacattcttctctgatttaatctggcctgcctcatcagagcaatacaaaaattacttaaaaatactgttttaacaggacaaaagtcagttttctatgaggaatgatgtataattctcaacttttccaagggtacatattgtaagagaaaaggtatgcaatggtttttcaaaatggtagaatgaaagtcactatataaaaaaataagtacattatagagatagtaaaatggaaataattcattgtaatgaaaataaaaaatcaagcttctgccataattagtatcctaaaacatgttatgtaattcaactagctacagaataacagttgacatgctaagttccatacatacttgactttccacttgaaataatttcttctttgggacctgtgtctcatccaaattaatgtgataatgtgatatgccttccagtggagactctaacatagttaatttttttaggctgtcagccgcttcttgttgaagttgtctcacaaccacctgagaaaaatatttttgttactgattttataaattgccttattattaaattatgttaataatatttaactctaacatacctactttgaaaattatcaccacacatatcaattcaccttcttttaatcacatgtacacatttttatttattactgaattcagagagggatgcacaatatgttctcttcctgccaagttggtattctcttacttacataacagattcatcccaccattcaatcatcttagaagctcaactcaacctcaaagttcctgacatattcaatcacctgttcaaatccttccaacagattcctatctcagaataaaagtaaaattccaatggcctttgaggtcctaggtaaacaggtctctacctctctctctgacttcaaaggtcctacaactccctcctgtaattactccattcccactgtacgtgaagcctgccacccctcagtctgaaaatagggatctaatgccttactcataaatcacaggcagctacaagtatctttgtactgaacaaaattatattccaatgatagtcattgagccttgaaataaaaattaggagctaattattaatataaatattcaaagtaaactataaataccagtgggaagactaaaccaaatatagttttgctaaatattaccacatgtatcctaaattatgattttataacaagcaggtgtctttataacattacatagtcataaaaatatgtaatttgacatattttcagatttgttaaattaatatgattaataacaaagatataccaactaaaatacataaaaagttacttaaagcaaggtattacaagacacagcaatacacttcagttcatctgggaaatctagaattaagtgtcaaagaaaatcagttaaattttaatttgaaaatactcatttcaggtgtaaacatttccatttatacttacattatggtcttaacatgtggcaacataaagtcattaaaattattatttcagcagtacagaactatctaccttaaaatatgactctgtgcctaataaaatttcataggtgacacaatgtcttttctcaaagtaaatcatctctcacctctaccttttatttcctagaaatgaggcacgtttctaagctggtatagtaaacacggttttcctttttttttattaaaacagctttgtagaaatataatttacatactatagaatgtatctgttttaacttaatgttaaaagattttttagtccatttactgagttgtgcagccatctctacaatccaactttacagcatttccatcactgcaagatccctcacgcccattagcagtcactaccagctttcagccccagccctttgcaaacattagtctacttttttccctatacatttatcttttctggatgcttcatgtaaatggaattatacagtatggtgaacacactttttatccattgatttttatattcaactaagttcaacatgtatccagaaccaaatgtttaaattttctttccaaaagtttgaaaatatttatcttccttgatacttactactctttctgctttctctctctcatattgaaagagactttcttttaaatgatcacattcattcattagcttcttatttttctcttctagcatgaggtctttctttccactctcaataaagcctctttggatattagttactatctctttatgatcctctttctgatgaacatcatctagttgctgttcaatgcacggattttcatgttggagttgacatatcctctcttctacacagctccactttccagtggaattattcactttagcttctgcattttcatacatctctttcatttcctttatttgctgctgtgtttggcttaggtcgtttggagagtttctaaagccaatgacttttttctgagagtatctcttttcttacggaacttatcttttaaggtattgaatttaatttgcgttttagaaagttgttcagtaagaaactcattcgtatcttctacttcggaaatatcagaactgatttttacttgtacggaaacatcttgtgttcactctaatgcaagttttaggtttctttctgttttcacactttcactgtgtttacttatagcagcagtcagtctagactgatgattcaatttcagcttccagtcttttgttgctttcttcttccttcaacagttcggaattgagccttgtattctcagctttgagatcactaagctcttgttgataccggaatgctgtttttgttatcaattcctcattgagttttatatacttttcaagggcagcatttgtttttttaacaattttaacgtccttaagatatttattttctttttccaggttgtcatttttcattgtgcatatttcctgtctgagtatagcaatatctgtcttcaaaattcaattttcatccatcagatctttcatttcttcgtgattacgaaaatcctaaataaaacaaaagaaagttttagctagtactcaataaaataacatatcatgattacctctgaagttaaagaataacctgcacgtccatatactaaaaaggttactgtaagtggatatccaactggagaaaaagttgaagcaaaactttgaaccttatagagcataagttcaaaaaagttcagaaatttatttaaagtcaatgaatttataaaagtaaacacacacacacacgcacaccagagaatttttaagaatttcagaattggaaaagcctttccctgaattacaacaaactcaaaagcataaattaaagcattaacaaatttgactaaattaaaatatatcaaaaaattgcatttacactttgatatctaacccatacactaccctatagtaagaaccttacttcacacgtatttggacagataaaatttcccagagttactacagttctgtttcactgataacattctatttcaatttgactcttttaacacttttatagtcagttgtaagaattacatttactaaatcataaatctagacattatactagtcactcctgtatacattcattgatgaactcatctagttaccacaattttgaaaaagaaatgttaaaaatataagcaagctacaggattttccccaggacttctgactctacttctagttctctgacagatcacagttacttctgtggtgtaaaagtatcaataagaaagaaaagttttctttcaaaacaccaatggtaaataagataaaatttatagagctcttcttagaatatcatgagattatttgtgattgcaataatttatttcctctttatagtattaggtacagtaatcaatatgaaatagctggaagtacaaggaacaattttactgggaacaaaatctttatcaataggttatcactaagtatatattatggcatattattgttttcaaaagctctttgtaataaaataatatcctatgtggatgccaagatttataataaatattaataattgtacctgtaagtgtcatcattcattttttgaaaatgagataacatttctggtttgttttataccaaaatattatatattaaatcaagaagatattataagtgacattgaaaaaataaagtttaaaatatagaatttttaccaaagattgatttatctgatttggagtatttcttgtagtcttcagtttcatgtctagtgattgaacagttggttcaagttgtttcgcttcaacttctttcttatattgtttctctttcctttctaattcttctctatttttttgtacagcatattaacatttgttttttcttcactttcttgtcttaagatgcatctgcagataaagacatttatcttaaaattcattttgttaaaaaacaaagagatcatcctgtaatctacctctgcagatgctatttatcatcctaataaaatttctatgttctggattatttttcctttgtagttctcagatatttaatttctcactccaacatcttcaaacgaatgtatatacttgaaaagtagtaaggaaagaatattctgctaaagtttttgttactagtcactctagtatgtattataaaaaaggatactggaaataattcagtatagttagaagttcaaaattaccttttcaaatcacacagtcataattactccccgattagaaaagatcatttacaatcaactaaatttttaaagttactatttattgacaagcgtgtaagttcactagaaataaattttcatctctatgaaatattgtatgtgtctctccaaatgatttacacagtaagatgtctctcacacaaactatatctgtagatgattgtcatctaaaactaggctaaagagtctaacatctgttaccccacactttttataattctttcttaatacttccaattcaccttcttattacatatattttatatatttattaagctattgttcattatgtgtaatatataattaatgcccttaataagtgtgtgtatgtttacacaagttatgttttcctgtgaaatctagtcccagaagtggagttgatgagttaaagggatgtcaggttatttgaaattttgatacacagcactaagttacccttcagaaataatttaccaatttcatataccaacagtgtatgagaatgcctttttcctcacattttcaatggtagtaattactttttcaatatcagcatgactttacaaaatatatcttattttatgttaatttgcatttttctgattaccaggcagggctaaatatccctggtaaaactataaaacttgttaatcataaggaacattagtccaattttgaattagtttatagcacaattacaattatctgctgagaaatactgctataggtggccaggcacggtggctcactcctgtaaacccagcactttgggaggccgaggtgggcagaacacctgaggtcaggagttcgagacaagcctggataacatggtaaaacctcatttctactaaaaatacaaaaaattagctaggcatggtggtacatgtctgtaatctcagctactagggaggctgagtcaggagaatcacttgaacccagtatgcataggttgcagtgaggtgagaacacaccattgcactccagcttgggcaacaagagagaaactccatctcagaaaaaaacaaacaaacaaaaaacaaacaaaaacacactgctataggcttacttacctatcatgctctttcttcagtttcttgggaaattgctgaggatacgttttcccaacctttctttgtttggttaatctgtcagcagcagcagaagatgtactatgacatacattttctgatagttgtattttttcacttttgtttgtattatttccttctttgacctttaataaaagtaatatgaataataattattattttattcaataaaaaaactttttccctgattttttcacttgattcaggttaactatcaccattttaatgataaaagtattttgtgcttactttaattttatcattatacataataattataagatacttatcattttatcattgaaatttttgtcaagtctgctcatttctgtttgagtgaatggaataattttccaaaatttcaaaaaggactcttctccattttgtgcttttattcgcatccactctttgctatctgatataaatgtttatgctatctgactggcagaaacagagaaataaaaagacacaggcataacatatatcttctgtcattgccacctggattttacatgaaatagccagattaagaggatgtgaccttgtaggccttcaggaagagtaaagaagttttccttttctgcactgagctattcttttccctactgccttttatctctctcttttttttttttttttggatcctgggatatcaaaaaagtgaaagttctccctgaactatgggaaccaatgtttgtcacaacacaagaagcagagtgaaactgctgagtttctagtgcagaattctggaaaacgagatgcttcccagatttcacattcaattaccacaaacgtttataggtggaaaacaaacggtacacttatctactatagctccattatctactgaaaatgggagtcaaaccaaccaagacatatgaaatgtttcatccagagctcttgaggtggcattccctagcatttcacggcaccaaatagcatgatataattccatattgctgaattacataaattaccagataaatttatcaaattagtcagatatattaaaagtctaacctgagcaaagcaatttaacacctcagagggtggaaaaaggcctcatctgcttttactttgaaagaagaaaatctctagatttttgcctatctttagaacacaatgtacagaactcaactttctactaaagagtcaaaggctaaatttttagctaagaaattatgcttctttcttacatgataaaaatcatacttgccaaaacttaccatactttattaaacaacataatgtaaggtctgattcaacagaaatattggagtggtgattttttaaaatatgtggaagtatatatttgttttcaaaatattggaaataaccatgatggaactataaattcaaacagtttgagctaagcagataaactggcgtgcatgaaaacacattaaacagactcatttggctgggaatattcattgcaactctcaaggctagacgtgtttttgtggctcatctcagtcattgcttccctcccattgtattcccattctatcattaaataaatgtaattcatctctaaatgaatacaggaaaaagaatctagaatctaaagcttatttctttagcaatttctttatgttgatctggttcagaaggtgacatggtatatggctgaattagtttcccagctcatatgccacttggaagactgagagtgagacttaggttgattaatgaagaaacattatgagaacattctccaggaccgttgtttagatagcaggactaatctactttgacacataattacacatttagaaaaccccgctgtaactgtacacatgagattttcttgaatagaaaatttgactaaatcaaataattgataaagagaaaaaagaagcagcaagtgaacctctgtctttttgaagttggactttctctttctccaaagccaggaactctacttgtaacatgcctacctcattctttttactattattatactttaagttctggtacatgtgcacaatgtgcaggtttgttacgtatgtatacatgtgctatgttagtgaccttggaatatcttgctgtaagtcttctagctatatttttgatgttctctcactatgtggcaaagaataacccgcattttataattcaagattcatggttttgtagttattaacactgggattgtcatacagcggcttctggaataagcactgtgttggttttctgtttttataagtatctgtagcagcagaaatactgtgactttctatctgaatcatatgcttcatttctttggggtgggtaaaccacaaatcaaaaagactttctggatctctagactgagaccaatgcctaatgtctaatttccaattagtggtatttgggtttatatatttttccatttgcatgtcaaactcttaatcatctttcatttcaatcataattactgggttccttactttttcagtttctatatcataacaaaaattttcatcatctgtgttagaaacaagctgtgtgtctggtttgttatcatttttatagtctgatttattttaatttaaatgaagcttagaagatgactggtaagtgtatttcagggacctggagtgtgaatggaataaaaagacatttgacatgggcttcctctgttcaggcgctgcctggactgccacagagctagaccctccagatacatttttctcctcacaatcaaggacatgattcatcagactagagggcactccttttttgttcatccctctttagagttaccatgtaggagctcttcctcagggcaagcagtaattttggagttttcagaacttttaccaatattcagcttgaacttgtttgtaatgaattttaaagaaagtcatgaatatatagattgattccctttatcactgttcttacccagttctggttcttgagacttttttttgggggggggcaggtgcaaaatggaaaacaaatttgcttgttttgtttctcagatgtcttttctgtcagagtgcatgttttaaaattagctttaatcaagtataaacaaagaaatattagaaaataattaaaatttaactgtgaaacttaatctatgtgttgctactcttaaattattggattgtaactaaaaagtgaaaaatagtttgccttggcttaacataggacagaaatatgaaacagcaagctgaactcttagtgtctgtttggactaaacttaatgcatttgtgtaaaatctaccagaaatgaattcaaagatgataggtagtattataaaagcttcctctcttacaaagactttacctcagcatatcagaaagagtgagcccctacagtgcatgtttatttctgaagattaactagagcactaggcaaacactaaattattaagagctaaactgaacaccaataagaaagagaagcaaaattttaaattctaattcaaatgatatactatgatagtgttatgtatctagatagaatttctgcttatatccacttctaatatattttaagttccggtagtgatagggtttggattttttaaattttagtaatgtttactatgtatttatgttgaaataaagttattgttcacaccctgacaccaaaggtcccattctgcaaggtaggattctcttaatgggcaactgcattgacttttatgaccccattcactccctgaacacagacacagaagtcagctggtgaccacaaaacagaataaatctttaacctcggcactggtgaccagcaatataaaactgcaacatttgaaacactggcaatgatgattcctttaacactagtttaactcagtggtcattgttgttaaactgttcataatttctattcctcagtaatatgacccaatacttcatgttaccttgtgtattatgagtaaggttacataaataaaacagcaagataattctgaaaatttcttgcctcaattccaagggtaaagacaactatgagttactagagatactaagaattactagaataactaatagttactagagatagtaagaatatcttaagtttcataactggttaagatgttttaaaaattaaatataaaattatgatctattggattctaaaggtatagtctgaaaggtcatgtcatttggactgtgctttgttagtaaagcaaaaaaaaaactaatattaaacaagaacttaaattttcatatacctgtgattgcttcttttcacttctttcacacctttcttgctcttcctctaaagccactggtaaggtttgttctgttgacaaattcattgatttagttcaaatgaactaagaagagttagataaagactataatctttataaaaataaatagagaataacatttctttgtattttatattttgagagtttgaatgaaacaatgtttactgaaatatttacttctgtaagaaatacttctaattatccaaaacttcaacaaaccacttggggagacaccagatatcaccagattcaagccatgcaaaatctcagggtcactcacaaattgttccacccaacataagtcaacaaaactgttggaaacaaaacagaaatttgaaatacagtcaaaatatacaatgtaatgctttactatacttcataacagtatctttttaacaagacactaattgagttggcagttactaataatttgcaaaattattgttgtttatacctcaattagtgtgcaccccattttttacatcacaaatgttttcccctgctattctgaaaaatttattttcatcttttaagactcagaaagtaggctgggcataatagctcacatctgtaatcccagcactttggaaggccaaaatgggagaattgctcaaggccaagagtttaagaccagcctgggaaccataggtaaccttgactctacaaaaaattagacaggtatggtgatatgttcctgttgtccccgctactcaagaagcttagatgagaagatccctcgagcccagaagtctgaggtttcagtgagtctcaatcatgccattgcactccaatcctgggtgatagagtaagaacttgtctccaaaaagaggaagaaaaaaaggctcagaatgctatgtgaaatcttccttgattctagctatctttctccacacacacaggtgtctgcttcgttggggtcccttagtaccttgtcaatttttctagtgtcactttaccacctgacctgcacatcatgtctttacatgttgaccccctttgctgctagactgtagaggacaatcttttgaatcatctttgtataaacagtcttaattttgctaaataattacttattgagttcctgctaagtgttaggcactggggaataaggaaggaaaatagaagctgtcagggatggctttcctaaagatcacccatgagctgagacttagagagtgaggttagccagattaagtgaggcagagggcaggaaagggtgagcacatgccaggcggcaacaagagaggaagagaagcctccaagagagtatgtatttctctgcagaagaggaatggtgaggggccattaccagcatctcagtaattccagagataaaggcagttggggaaagggatacagatggagatttgggcagaaatcagtttcctttccttttcttttttgggacaaggttatactctgtctcccagactggagggcagtggcatgatctcagctcactgcaacccggcctcccaggttcaagtaattctcctgcctcagcctcctgagtagctgagattagaggcgcgtgccactaccacctgctaatttttgtattttattagagatggggtttcaccttgttggccaggctggtcttgaactcctgacctcaaatgatccacttgcctcagcctcccaaagttctgggatcacagacatgagccaccttgcccaacccagaagtcagtttctgaaatccttatataaacctttaagatgcttggacattaggtattcaggagtggttcacggatctatttgcattagggataattcactctaaatactgtgaggagcataaaattctgaggcatataaatcaatgaacaaagataaaatataaggcaatgttgcaaagatgatgcaggcctgaggagatgttttcagaaatatttaggatataggtatcagtggccattataagaatgaatttctattgaataaataaatgtatatatctgggtccctggagaaatacactctgctcattactttacaaattttatcaaatgagaagtaaaataatatacataaactctttcagttacttgtatttactttaccctttttctgtttcagttttactgtgccaaggaaatgcatttgggttttgtggtggttgttgtggttgtggttgtttttgttttttgagatggaatttcactcttcctgcccagtctgaagtgcagtggtgtgatctcagctcatggcaacctctgcctcctgggttcaagcgattctcctgcctcagcctccctagtagctggaattacaggcatgtgccaccatgaacagctaattttgtgtttttagtagagatgggtttctccatgttggtcaggctggtctcaaactcccaacctcaggttatctgcccgcctcagcctcccaaagtgctgggattacaggcactagccactgcacccagcaatatatggggattttgttttaaaagttctgtttcctggatctaccaagctcatgagaaaatagagcaaacaagtcatttgcataggtaagaaactttggatttatagcttgtcctcactactctagaagattatcatcatgttttgcaaagcaaaatgttaaacacagacacaaggggaaaaagaaattaaaactataggggtgggtgaaaaaatattgcataatttattactgttgacctcatcatatgactgattaagggcactgaatttaacttggatgtgaagtagacctcatattagctgcagttaatcagtagaccaggcgtcctagcagaattaaatttgatgctcctgtgttatctttaaaagacacagcttttctgaaaacccttactcatagtgcatgattatccattaagaaaaggtgatggaatatgtgaatacagctgaggagacaccacaaggcaaatgctaagtggttcccattaatattgcaaaaatcaacactataaaacagaaagccatagacattatttaatatttggttttgggaggtatttttagtgacactgcatacagttgtacctaataattgctaaattagagacgtaaaagtaaaacaaaggcacattgtgtttgagtaggaaatctatagacatctagctggttttcccatccagccgcaaaattctaaatataatcatggtacctgcactcaaatttatgttaaataccaacctcaatgaaatcactctttcttctcattctctttgttatttatatgttgctttccttaagggaagaatacaaatgccttgctaagaaccattctgtttggttgtaggctgcataagaggagtaaacacaaagtacatttgaccacaaaatgactttttaaaagtcagaactatggtagcatgaagccaaacgaggtaatctagaataaaattttctatgcttctttcccttctttgctctcttgctactctaataactgcgattcacacaggtaaagaagagtgtaattccttgatagaaacacagctccaagattaatcctttctttaactatgaagttcgcgtgtccaaaatctgtggtagttgctgtctgatttttgatcactgattgtgatacagatatttatcatcaactcacaacttcccaaatctttgaaaagtcttactattgatggttcaactagtagaaacatgatgtaaaatatctgaaaataaagtttttatttattagaatgtaaataataatacaaattgtaataaggtgtaaaagttctttcttcactgaagcagtgtggggttgtcctctaccccacaaatgcactactcccccttggtctaatgtattttaaaagtcttgtaattgctattaactcagacaagtttacttaacttgttctaagcttctggtatttactacagtttactttcaatcactcaaccatctctgttatatatgttgttttccatgagaaatttgtttattagtaattaagattcttcaggtataagaaaatatttgaataactaagtttgtgcataaacacattaaggtcaaatatccatgacattattgtgtgtttctgtgtactagagacaaaaacttcaaaaaaaattttaatgaatatacgttaaattaaaaactgctttcattaaactgagataatcttccctcaatgcatgaataccttcagaattcacatagaccaaagaattgtataaaatataatagccttaaaaatcttatttgtagctggcacaatgactcccacctgtaatcccagcacattggcaagccgaggtgggcagatcacctgaggtgaggagttcaagagcagcctggccaacctggtgaaaccccatctctactaaaaatagaaaaattagcagggtatggtagcacgtgcatgtagtatcagctactcgaggggctgaggcaggagaattgcttgaacccgagagacagaggtggtaatgagccaagactgagccactgcactccagccttggtgacagagcaagactctgtctcaaaaacacaaataaacaaacaacctaatttttcccatataagtctatgttcatacaagatctgaagagtacacaacaccgtgagacaggacagacatatattttaaaagttatattcctggtttctgtaaaaataaaatagttgaatttaagctttcaagacaagtcaacgaaaagagaatgcaaaagtgaaactcgaaaggtcatttccccatcaagggctcatgatcactggacattcacaaactatattgttcaaaacattagatctgaattttgatccgagtatccctttagtagcagtttcattcaaggatgtccaagaggtaaaataagacaatatcatttgctattttcagttttcttttctgagaacagcccagcattcttcttcagagaaatgaattgtgctaacttcataggctaaaggctcatgagttctaagggtattaataaaatatggtggtgtatgcttgtattctgaacttttcaggtttaaactctcatatagtaaatgctaatagatacaaaccgattaaagaaaagccctcttaatctgacattatttttctttttatttcttcatttatcagcaacaggagagtctaactaaatgtggtaaagtggtatgagggaatacaatgaacagtgtaaaatgaattaaaccagggataatcacaccaatgtgggtacaactggaaaatataatacaaaacacaccaaagaaagtggcagaaaggtatataaagtgtataaccactcacataccattttaggacacaaaaaattctgcatattatttctgagcatcacaatgtagttaaagatttcaaaagggcattgaaatgaaaaacaaccaacttatgatgttggtagcctctatgcaatcatgttttaaaaactttaacaccaaaaatgctcaaaatcaccattttaaaagactgtgtctaccagtcataaatgaatcattactttcgtcatttgtaatagtcaaagatgccacaagcgcacgcatacacacatctatatatacacctacacacacagtcttgctcattagaacatctgataggcttcagatcatcagtgtaataacactagcagcaagcctctgaagttaaaacagaaactgacactttaataagtaaagctttcctctaggtaaagatcagaactccaactagcacttaactcactggaaatatcttaagagtctcaaaattcactgctttgaatccctgacaagtataaaaattttatactgaaaacttcatgctattcaaaacattaaaacagaaacatctgacttaaagcttacatttttaaaatcttttttatgcttctaaatttgtttttattcaaatatggataccaacaataacatttatgtcaataccttctgttcaatattgaacaaatagaattaggaataagaataatatgagtacatccaatcattgaatgtactttatttccagtattccattaaatgtacctgctctcaatgtctgtacattctttctttgtactgctcctttcacagcaggatcttccacttcagtgctaggctgaatgggttttaaaagataacgattcataaatcatatatattttatacaacatggagttagtgattcaaaaatatacataattaattaccttcaaggaaggatgttttgcaggaggccctacaaagcaaaggggatatgtcatcaattatatgtaagtatgacaaggccaaccaaacattcatgcagtgttactgtcgagctgaattctcaggcctggctataaaaataattacttaaggttttgagggttcttcttggcttcttcttttcattgcctaggacagcaacatgacagaaacacaatgaggaaaataagaatataggattcacaaaatgcacagtttacatttcagtagtgagattatgtttcaaatgcctatacttaaaatagaaaagcattgatataaccgtgaacatgtggactgatgaggagaaaagggaccattaaacagaggggcaaatcaaacctgagagaatcaatgtcaaagctgatggtgaatgtacagagtattttaactccacacaccagaggcattgctggcagcacagcacaaataaattccccttgtcttgtcactgaggaaatacgcagttgggatgacagttcaggtgaatgtgtgattcacctctcatcaaagaaagggttctacattgatcagctaggatacacacttatgaaataacagctaatcaaactactcatttttcccatgatcacatgggctactgcagcacctacatttctcctatcccctcatttggccttgaattagagctccttgatccactcatgcaagatggtccataaaacacatcaaataaaccatgtcgaataagcttctgatatgaaaatatttatcaaaaaagaaaacattaaatgaccacagacttgctggatattaatacatatttatatttcaaaatcagtgcagtatttatgaaaatgataattttggttttcatggaatgaattttatgattacttctaaaattaactaagtttggtatattatcttacactgtaaaggacttttataaaacagctatcatatcaaagaactggctgtctcaaaaaaatttcgccaaagcatctatatgcaacttaatcatatcttattcactcatgtcagtgaaacttctccccctgaggcctgacagatatcaagtgaaatgagctgctgtggtttaccccaactctagcactccctcctgtctccagtactctccacagcaataacctcttttgtgagactgggcatatgctgaagcaactggaagtgagttgtctcaagttaacttggctttaactcccaagaccccagcaaatgtctttctttcctccttttgtgtcctttcaccatccctcttcctttgaaaaaatgattatcagaactgtcatcctgatgtttcccttcctaactgctttttatggatgattgtgaccacttttttcatctgtattcagcagtagtatacacctgtaatctctcttttttcatctcattttccttcccctgtggctagaatcatgctcagaaataaaaggaaattaaagctttccctggattctgttatcttttaaattgctctccagtggttctttttccagatttctctaaaggaaggctattcccttgctattcagagctgtgtccaaggaccagcacaaacatcacctgagtgctcatgagaaatgcagactccaatacctgctgagtcagaatgtgcactttccagaagctcctcaacgaattcatgacaatttgaatgccctgttctacactggtgtgcttccatattggtttaccctaattggcctttttggcctagcctcaacttctttcctattatgtccctgaatttaatactacgttataagccataatgtttctaatgaacttttaatcaggcaaagcttctctaattaatttcttcccaataaatcacccaacactattcttttcaattatgttaatatgatactatcctatgaagttacaacattttctatgaaaacaaattacagtcatacatggctgaccatttatggtgatgttcatctatggtagataaaacacaggtctgcatggtaaagtacctcaatccttaatgcctccccagtagcgagaatgacagcaagagaaggaaaatgttactgtaattatatgacacattttggtactggaagctcactttatcttccttcctatttctaacaccctgttcttccttcttctacagatcaatttgactttactaccctccattacatacatccacttttttttatttattccatgtacactctgccctcctcattctttctttctcttttattcatttcctcttccctctctcctgacttgcctcaggtcttagagtatgttaaaatggaactcataactcagctcctttagtggtacttccaatagaatcaactgctgacccttggttagagacaccacttatcaacatttcatttctcttttacttatgatacagttaataggacattttctttagctattaaactctattagtgctcatattttaaaagaaacattccatcaatgcctttttttttttttgagatggagtctcactctgtcacccaggctggagtgcagtggcacgatctccgctcactgcaagctccacctcccaggttcacaccatcctcctgcctcagcctcctgagttgctgagactacaggcacccgccaccatgcccggctaattttttgtgtttttagtagagatggggtttcaccatgttagccaggatggtcttgatctcttgacctcattacccgcccacctcgggctcccaaagtgctggaattacaggcgtgagccaccgcgcctggtctccatcaaatgactttttaaataaaatacggttctcaccttttccttttccattgactattctgtttcctttttcatgagaaggtccacgtaaaggctctgacactttctcggggacacactgctaaggtaatatcaagaattagtttccatttaaaattataatgagttgcatcaagagtttcttatcaatctctttttatgaaactgggtctcactctgtcaacccagggctagaatgcaggggcctgattatggctcactgtggtctcaaactcctgacctcaagcaatcttcccacctcaacttcctgaatagctggaactacaggtgcataccatcatgtcatgctaatgtttttattgttatctttgtagagacaaggcctcattatacctcccaggctggtctcaagctcctgggctcaagcaaatcttccacttctgcctcccaaaatgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagttggagacctgcctgggcaacataatgagaacacatctctacacaaaaaataccaaaaggagtcaggcatgatggtgtgtgcctgtagtcccagctgcttgggaagctgatgtgggaggatcacttgagcctgagaagtggatacagcagtgagccaagatcatgccactacactgcagcatggacaacagagcaagatcctgcctccccaaaaatttcaatttaaaatgtgagaacaaagagagatacaaacaaaaaacaagcctaattagtcaatgaaatatgagcttaagccaagaaagaaaatgaaaaacatgaagtacaataaagtacatggggaaatagatctataacagagccttcggtctttcataactctgataatactaattaatatttatgctgcaattagttttttgtaagtacttctgtgatagtgtttcttactataagacattcaattaactaaatatggtcatctaccattacctgaaagaacattattataacagagagagaaaactggaactttccatcaactttccacccagaaaaagaattggtcaccagaattctaaagagtaatgtatggcagacacatgaaaaaatgctcatcatcactggccatcagagaaatgcaaatcgaaaccactatgagatatcatttcacaccagttagaatggcaatcattaaaaagtcaggaaacaacaggtgctggagaggatgtggagaaataggaacacttttacactgttggtgggactgtaaactagttcaaccattgtggaagacagtgtggagattcctcaaggatcaagaattagaaataccgtttgatccagccatcccattactggatatatatgcaaaggattataaatcatgctgctataaagacacatgcacatgtatgtttattgcagcactattcacaatagtaaagacttggaaccaacccatatgcccatcaatgatagactggattaagaaaatgtggcacttacacaccatggaatactatgcagcataaaaaatgatgagttcatgtcctttgtagagacgtggatgaagctggaaaccatcattctgagcaaactgttgcaaggacagaaaaccaaacaccacatgttctcactcataggtgggaacagaaaaatgagaacacttggacacaggatggggaacatcacacaccatggcctgtcatggggtggggggagaggggaggaatagcattaagagatatacctagtataaatgacgagttaatgggtgcagcacaccaacatggcacatgtatacatatttaacaaacctgcacgttgtgcacatgtaccctagaacttaaagtataataataataataaagagtaatgtatggcttgaaacggtgtatttaatggaatatgagttgggtttaataaaaagcttaagaaatattaatctaaaatctcagtgttaagattccagttgaatgatactagaaaatatattgtaaccctctttgctaccgatggcctatttctattttacttcctttttaattatggcataatttctcaacataacatgtcaaaacttatacaccgttaaatattaaaaaataatacaatgtaagcaatattttaaatacaatatttaatgattagatacattaggtttattatattacttataacattccattatataaaaattcatttgtttatttattcagattaaacaactattaaggctgaatgtctcatgtctgtaaccccagcactttgagaggctgaggcgagcagaacacttgagcccaacagttaaagaagagcctgggcaacaaggcaaaaccctatctctacaaaactcagcccagcatggtgacacaggtctatggtgacatagctctattgtttcaactacttggatggctgaggtgtgaggatcacctgagcctaggaaatggagatcggagtgagccaagatctcaccagtgccctccagcctgggtgacagagtgaaaccccatctcaaaaaacaacaagtaaaatgcttcttacatggaagactgtattctaggtactccaggatacacacaaatatgtttactgacctccagtagcttatggtatgcaggagcttccaatgatcatttaaaaaactaaatagaaaaccttctgacattcaaactttcagaatatgatataaggactttgagtggttattttattttattttattttttaagatgtagtcttgctctgtcatccagcctacagtgcaatggtgcgattttggctcactgcaatctttgcctcctgggttcaagcgattctcctgccttagcctcctgagcaactgggattacaggcatgcactatcatgcctggataatttttgtgctttttttttttttttttaagagacagggtttcaccatgttggccaggctgatcttgaactcctgacctcaggggagctacccacctcggcctccaaaagtgctgggattacaggtgtgagccaccacgcctggccaagtaaatattttaaataaactacaatgacaaaattatgatgataaagacttaccatattggtattaagagtctctgcttctagaactggttatttgcaggaaaatacatgttattcaattagatgaagtgttttatataaactcttcatggacaactcataaatcacataaaaatccctttgcaatacaaatcttgagaacataaatttaaatttctacatttccacaatttatatttttaaatcagatacaatgttacccaggctgttctcaaactcctgtgttcaagcaatcttactgtctcaaactcccaagtagcagggactacaggtgtacaccaccaaactcagctatttttctacaacttttaatacttttttagtctcactacagaaccaataatataagtagagaaacaatctctcctaaaaactatatgacaccaaaatgataagtttccaagaacaaaagctatatgttatgtgctgaacatttctgccactaaaaattaccaggaggattccatgattactgcaaacaatttgatccactgaaggtttatacaggaataaatattaagaaagtcacactcgtatgatttaaaagtcaaagtattagtatttatccaaataaactttaaccaaatttcatatttcctctattggagaaagcatttcctaatgtgattttcccgtgactacttattttccagttcattttttttcagctcccaccctgtcacagtacttaccaatctttattagttaccaaagtttaacacattttttgaatcaactagccatgtgtatgtttttctctgaccagctttccattaccaccataaaacaatgataggtaaaccactgctaaatttgaaaagtaaatactatgcaaaactacactcagagtgagaagattaattttacaagagaccactttaccttagtagcaacactcaagtcttcatcatccaatgtaggcaatgaatccacacacagttcatgcaaaatgcttgagagcaaaaatacacaatgaaaatgagcaagttgatttctttacaatttttttaattgccagtttatatccagcttccccctcaaaaaaaggaaaacataatctggggaaaggtcagtgatctatatattaaattatgattcttgatataattaaaatatgtcctctgttctaaaaagagattttagttacctatttctgcctccacctgtctaaatctataaaatattcaatgaaagctaaccttgaggtttataacaaatagtgacagtcaatatattggcagagcctgacaataatgtgccctcacaaattatctgtcctgaagctgaacttaaaattcaattaatggatgacataaattttgttccctaaactggaataaaactgatgacctaaaacaaggtagaaagatccactgtctcttttccatgatctgtctctggataaaacactaatctacatcacttcaaaatggtagtcttgattcctcagcatggatccaacttaggaaggtcctattgatttcctttaccctaaattggtacaggaaagcccccacaatatttgaaatgtatgaaagctaaatgtacagaagtcaaatagcaaagatgtatgttcttattgagaatacttttcccagaaagattaaaatattaacaattataaaatcccattattttcactctataggtcctaccttattcaggtccacataaactagcaagcccttaaaaattttcataggcactcagacacccaaggagagagactgccagaaaagaaacagagtcatgatagttgtacctctatttccctaagtactatctaagtatatttcttcctatggacacccacttccagattctacttctgcagggttccacagaagtctccagtcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagaggtgaggagacacctgccctgtgccacacatctatgtagttcagcaatttccagccccttagtactccaggggctctaagccacccctttgtaagtcaggatggaagtagatgacaccacatttctatctgctgtagacattcttcccagtgtctcaatatgttttggcatctttcagtaaaaatcttcaagtttgtcagtccttgatttaaaaaaaaaaaagcagcaaaatttttagagctcccttgaaccttctattttaatgtgcctttgtagataattcccaacatcttgtgtccttcatttttataatttatctttatcaaacttgtcataaaccccaatactttgatctcttgtagaagagtccgtactcctatccaatccagtgttgtttatcttcaaacttggactgcccctgctcattccattcttatctacttccattgggttcaccagctaattccattctcattctatccacagactcactcccgtttgtattatgaaaacacacgccaataggacataaaaagaagcaagagtactgggctttaccatgagttcaaatctcatttctgccaattcctatgtctaaaaaaaagcttcgtaatctctttgagcctcacattctctatctagagaatcacttgaccagaatgttcaacgcagagaaaaatactagaaggtattttaattcattccaagattccttaaaattctgtaattctatgtcctcttgattctgtctatagaaaaacttggaatacatgggcagcagagtttgaaaaaataatagaacaaaagaaacaccaagaaaaacagagaagaaagttttaaaaaatgaagacaagattatataaaagtcatggaaaaagcaacaagactaaaaaatgtattatggaagtaagcagaaatacttgcctaaatggaaaaccaaactgggaagtcaaataatttgtctctaagacttgcctaaacttgctttggtaaaacttacagtcctatggccaaagctaagtcagatctgccctagagcctttgaaggtaaaaataagatactggttaccactgaaatcgtcaaatttattaggactaaccacattctaacaataaacttaaatgagagttcaaggtatttaaactctcattaatttagaagttaatcaaattaatgaatctgattgatctgattcagacctatactttgatccaagggctgcacagatatctatcaatctatgctgaggagcaagagaaaggatttggaaggcagacaggctgatggtcaaactgtaggccagctactttgttaactatgggatcatgaggcaattaatcagctctaatccatagttgtttatttaacagtaggttataggaacacagatgttatgatggctttatgagatgataaatgcatagaacatattaggatgtctagcccagaatacaacactcaacagatattagtttcttccatctatattttcttagttaacataattttttaaatctatgaaatcttacctgactgcagattcatcagaaattccaacatctattaaagaaaaaggtaaaatgtattttaaatcaataataaatgtacagaatattaaaatcataagaatgcacagtgatgcatgcctctaatccaaactacttgggaggatgaggcaggaggatcacttgaggagcccagaagtttgagaccagcttgggaaacatagtaagactctaccttcgtaaaaaaattgtgcacacttgtgtgtatgctttagatcctgttttttgttgttgttgttttggtttggtttggttttttaaagcataagactgacgttttgttacaaagcattcctttgggagcatgcctgggaacttattagaattaacattcattataagtattggtaggtaattaatgcagtaagaactcttccctctgtatttattagatgcaaagaagaataaatttattaaaatttggtatctacaagtgaactgaagtatacaagtcatcctagccaaagcctatgagattgagtaaaaatggtattgttagcagaacaggtgtgatgagtcaacagtgtcaaagagcatgatttctggaccaaaatatgaggggccattacaacagagtatacactagtaccccttatccactatatgcgcagaaagacatacttgacacgtttttctctgctgtcacaccacagcaacaatcatcaacaaagaaggcttctgtaaccaaatgtgtggagagtttttccccaccaacaaacaagcaatcattcctgctgatgacacaattcaattctcacaccctatctacagataacatcagatttaatttaatttataaattaaactttgtcatagatatgtatgtatagggaaaaacagcttgtgattcagtaatattcatggtttcatgcatgcactgggggtcttgaaatgtatctcccacagttaagttgtagttactgcacttattttgttataacaccacacagcctctctagctcttcagttcaaactgtttagtttagaataaaacatgctatcgccagaaaccaacaaaacataggaatcagaccagaaacaggaatccttgcaaatactttccagccaccagtggagaagatctcaagagagatcagtgtgttactctggctaatactcttctgggtaaggtgctgggtggtttccttagttgtagctatttgctctggcctacgtataacaagccccaaattcacctgccattttacctcccacagaaagaaccactggaaagatcactcctttaagagcttatccacattcagagagaagctgaataaacactggggaggtatggcaggctgtcgggcaatattatctgatgtgaaaaaatatatagaaagaaaactatcaatgcccttttactaccagaatgttctaatgcttgcccatctccctagtaggagaaaaaaattttttcacctcgcataaagcaaaactcccttgtcatctctcatgacagaatctagttgtaggtgagtcatgtcatcataatacaggctgttgtcaacctcatccctcaaaggaagaggatcagtgaggaacttatgtatttacctaatagcattcactgcctggtcttatttccaaccgaaggtaagtatgaaagactttgtgattccagttttataaatcacaaccctttgcacttgtcctcttccattgctaaagagtctatctggacccacctcacagagcaagatgctccaggttgtgctgtgtagtacggagtggtgtccttttcctcaaccctttctattatgtgccacatatctatacaaatcatgttttctaagtatgtaaatcatatctcatcagaatacatcattctttacaatgataaagaagcaaaagaaaaacaaaaggacaaagaacatcttaaatgactacattcaactgccatggagctttaattttttaactactcaaaaagatatccactcttcttattccaactatatgactcttctgaaaaaagtaaaactatgaagacagagtaaacatcaatggttgtcacgagttgctagggagaaagggagagatgaacaggcatagcacagagaatttttagggcggtgaaactgttctgtcgataatattacagtaatagatacatgtcatgtcattatacatttgtccaaattcacagaatgtacagcatcaagagtgaggcctgatgtaaactatgaacttcaagtgattataatgtgtcaatgtaagttcatcagttgtaacaaatggaacactctctggtggaaaatactaataatgggggaggctatgcgtgtgtgggaggcatgggatatatgagaaatctctgtaccttcctctcaattttgctgtgaacctaaaactactctaagaaacaaggttattgattttaaaaaaatattcagctgggctcagtggctcatgcctgtaatctcagcactttgggaggcaaaggtgggtggatcacctgaggtcaggagttcaagaccagcctggtcaacatggcaaaacctcatctctaataaaaatacaaaaattagctgggcatggtagctggcacctgtaatttcagctacccgggaggctgaggcaggagaatcgcttgagcctagaaagcagaggttgcagttaaccaagatcgcaccactgcactgcagcctgggagacagagtgagattctgtctcaaaaaacaaaaaagatattcactgtctatgcatcccaggatctccagaacaacaattaaaataaataaataaaaaagatggctgggggcagtggctcatgtctgtaatcccagcactttgagaggctgaggtgggtggatcacctgaggtcaggagttcgagaccagtctgactaacatggtaaaacctcatctctactgaatataaaaaattagccgggcatgatggtgcatgcctgtagttccaggtacctgggaggctgaggcaggagaatcatttgaacctgggaggtggaggttgcagtgatccaagattgtgtcattgcactgcagcctggtcaacaagagcaaaactctgtctcaaaaaaaaataagtaaataaaattaaaaataaagatattcactgaacctgttactatgatatatttaagcaagacacggtgaccctaaaaattagagatcattgaagaccaaagtaacaacatgtggtcattatttctcaaattgaagtatataaaatatataaaataagtaaatttaattgcatgcttaggtaagaaaatattgataaaaatgattgaatattttatcttatttcataattctaagcagggctttagcacaatatgaaaactagattattcatgtaatccaaataaaagacaatttttattctaattttaactcagaaattattttgcttatttaacaattttactgaaaggtaaatgagataaataggacagattataattacctaacattgctatggtaacttatgtacaaatagctgttcgtcaccgaaagtcaaaaaagtaaccagcgctgcaacttaagatggatcatacaacagaaattagtaccaagttaccttatcttataatatgttattaaaatgaaattttaaaacaacaccaaaaattaagttggggctatacaaagtgtgcagaaaagatttcatataacaggcaagagactgccatccttagaaaggcctgcatgcaaggctggcccttggctggtgtttaggaaattggaattgggagggtttccaccattccctgagaagagtggctcactgtgtctaaagtttttatagaaaccgccaatgggtgaaatctaaagcagcagctggtgtatccattaacattctcaaaacaggatgcatctggacccctgtgtgcaatcttcatagcacacagacactaaacagaaaggcagtcattgctgccaaacaggacccaaatgccacacacagtgcaatgaagctataagctccctatggagagaaaagtagacaaatcaaaaacattcaatatccaatccaagtccacattaaatcttgattccagaaacgtgcattaaccacttcaaagactaaaatttaaaccatcttttctatagcgatttcccatttggttggcaggcatacaggggtagagaatgatttaatttacttacaagtattcagaaaagatagtgacctctacattcaaccagctacagcagcttagcacccagccaaagcctgcatctctcccaccttaagatttagtggttggctaaagttagcagcatccaggccacatctatctctgcattctaagtttgcttacaagataaagatacaaatgcaggctggctccaacctagccagagatcccagccccactctctgcatcccaaaatccctcaaagacccaagagactttccagatttctacagtctcctcacaggttcccttgacagttaaatgccctctctttacctcaactagctgcaggtagaatataatgggtacaacagaaaatcactgtaagtgtaatatgaagatacacagcccttttaagcatttcattatattacatctagcttacctctaagggatttattcagatgtgactgaagaaagtctaaagggaaaaaaagcaatttaatttgataaattaaattatcaattatagccaaattatttggctataacaaattaaacattttaagcagacagaagatgcaaacattttaagttgacagaagatataaaatgttcactatcaaaatgtcgcaactgataaaaatgttctcaaatatttctgtctcaaacttgcattgttcattaaggaagcaaaataggtgggacatacacagcaacaacatccctcaaaaaacaccttggctcattcctataagccaggcagcaaatacatcatccttacatatgttaattaccttccaatttcaaattctcaactgtgaaataaagggccattttatttggctgcttctagttcaatatgactgtttttattaaaacatctctaacttgaaaaatatttggtgttttctaaaaaactgcaaattgccacaaatggccagataatttggaataaacaccctacagaaaaaaatatatattcaagttgcataagtcactttgagcaatcctttgaggatatttcatttatatctaaatgaaccacaggtttagctggcttttccggaaaaccagaagcaaataatgtatgattataatgaaaaccatctcaagtaattttgaaatgaagtaccacatgtcttatgctgtcccttccatgcacttgacaaaacagcctataacaaattgtttactttgagatttaacgggaaaattccatgaggtttaaaagagatgactactaataagccatctacctttgactctattccaattaaaaatgggttaggaaagtgctttgaaaatcaagtgtgttcatcagggaatcatttacctaagtcttcttaacactgcttagtgaatattcagcctgatatagtaaatacacgctaaccactgaattgaaggggaaagagggagaacaaagagacatgtaaagtacacttactttttctagtaggaaaaagccaattaaaactatcacctattagttttattggaatcagtcttacaggagttcaaacttcctactgttgctacctattctcaatatttttcttatttcttcctaagcttctagagccgtgctgtccaataaatatgtgagccatatatgtaattttaaatgtactagtaagccccattaaaaggtgaaattaattttaaatatacttaactcagtatgtcccaaatagtaatcatagtaataattttaacatgtaatcaatataaaaaaatatcaagcagatattcttcgctgttcttcccactccaatgacaaaatccagtatatttaacacaacatatctcaattaggactagccaggatttcaagtgctcaacagttacaggtggctagcgcctactgaattggacactgcagtttcagtgcattgaatttctatcccacttagcgctaattaaaacttcaccctctcacctgataattatgctaagatctcagaaagtaacccactacaggcagtttcaagccctaatttacctctaattactcttacagcaatgcaatgaatcatgatttaaaatttaaaaaaaaaattgctgttaaattattagtcaagcgcccagggcaatggacagtagagaaataatgtaggccacgggccgagatgacaaaacggtccttttatttaaagctataacaataatatgaagccagccctgtaaaatagacatccaatgaaaaaggcatgctagttcttttgcttttttgtgtacttggcctcctgtgtccctaaacagacctcttctcagcagggcttgctcagcaagtcacttgttgagtcttgcggtcaacagaggggatagggaatggcaggggctggcataggagtgagggggaggaggcaaggtgaggggggccaggtgaggaggggggcacttgaaggggagttcaagaccagcctgggcaacatggtgagaccaccgcccctcaccgccgccatctctggtctcactctggtctcacacacatgcacaaattaaatttaatttaaaaattaaaaaattgttttaaaataagtgaaatgtttacatggattacgtatacattcattttgtagaactatagatcccatgtaactgggaactctttactcttctaacacaacatttatttagccacaaataaaagaccagtgatgtagcctgtacacaaaaaagtaagaaaacactggttaggctggggcaggggtggggggaagagatctacaaaattaaaattttattgggaaggatcactaattagaatcagaacaattactgctttaaagtagttaagaacagagcacaaggaacccagagaagaagcagatatgattcagagcagaacttacagagcagatggtatctgagccgagactgatagaataacattaataagggcattcacggccatttattatcacttaactgcaatgcattttgtataagttatttctactcttcatatcaaccatggaaaataatacttattcttctcttttgaagttaaagaagtggtaagtggtctaagaagataaattaacataccaacaccaaatagctcaagttcagtgactcaagagggcccgtgtctccccaagaggttgctcagcaggcagacgaggtagagagcccttccaagaagtgacagtgagatgtgaaaagtctcagtgtgtctctgagaacaacagaaaccagtgtgtagaccaagtgggaaaagccacggaagaggcagggatttcctcttaagatagcaagaataaacagagcagggctgagggaagccatggaaaatgggcagaataccatgcatttagtgagaaaaaaacaacttttactttagaaagggggaaagaatggtggtggtctaggtaagcctagaagcagaggaaagggcaatggagaaaaaataaacaaaatgtatgagtcagggttctccagagggacagaaccaacaagatgcatgtatatgtataagggagtttaccagagagaattggttcacacggttagaaggcagtcccacaataggctgtctgccaggtagggaaagagagaagctagtagtggctcagtccaagtccaaaagcctcaaaaccaggaaagcccgcagtgcagtcttcagtatgaggccgagggcctgagagcctcggggaagctgctggtgcaagtcccagagtccaaaggcataagaacctggagtctcatgtccgagggcaggaagaagggaagcaagtgtcctgcacgggaagaagaaaaaaagagagacagaagcttcagctagcaaggttatcccatcttcctccgcctgctttattctatacagtgcagcatgtgtacaccacttctgtgatattgtttctaatatccatgggaagaaagagtgatgttactcccaatagcatatgggggtgtacatcccctgtgatattattcctagcatgcaggggcagggaaaggatgacattactcccaatatcgcagagggtgtactccccgccttgtgatattgttcctaatatttaggggatagtgggtgatattactcccaatatcacagggggtgtgcaccccccgtggtattcttcctaatatccggggtggggggagaggttgatattactgtcaatgtcacagggggtgtacatcctcccgtggtattgttcctaatatctgggggtggggaggatattactgtcactatcacagggggtgtaggccccttcagtgatattgttactaatatctggggggggagaggatgatattactgtcaatatcgcagggggtgtacaccccctgtggtattgttcttaatattcggggggggggggagaggaaattactgtcaatatcacagtgggtgtacacctcttctgtgatattgttcctaatatccgggggggagaggatattactgtcaatatcgcagggagtgtacaacacttctgtgatattgctcctaatatccaggggtgggagaggatattactgtcaatatcgcaaggggtgtacaccccttctgtgatattgttcctaatatccaggtggggagaggatcatatcactttcaatatcgccaagtgtgtacatcttcattgtgatattgttcctatatttagggatagtggattacattactgtcaatatcgcagggggtgtgcacccccccatggtattgttcctaatgtccagcaagggagaaaacactactacttccaatatggcagggggtgtacacgtcgtatgtgatactgttcctatatccatgggggaaaatgatattgggaacaatattacaaacaatatcacaggggggtgtacatgtcctgagatatgaggagtaatataaccctctccccctctagatattacaaactgtatcacagaggggtgtaaaccccctgcgatgtggaaagtaatatcatcctctcccccactggatattacaaataatatcacagacggtgtacatgtgaggtgtttacgatattgggagtaatctcatatcccccagtggatattatgaacaatatcacagaggggtgtatacacactctgccttatagggagtaatatactcctctcccaccctggatattacaaacaatatcacagagggtgtacacacagggtgtttatggtattggaagtagtattatctcccccatggatattactaataatatcacaggggtgtgtacatcccctgtgatacagggagtaatatcatcctttcccagcctggatattacaaacaatatggcagggggcagtacaccctggcgatatgggtagtaacatcatgtcctccccacgtggatattatgaacaatattctagggggttgtacaccccctgcaatatggggagtagcatcattctctcccccactagatattataaacaatatcacaagggggtgtaaacttcctgcgataaaaggagaaatataattctttccccccagagatattatgaacaatatcgcaaggaattgttctcccatgctgtatggggagtaacatcttcatcttccccctggatattacgaaaaataatgcaggggaatgtaaatctcctgcgatatggggagtaaaatcattctctctggccaggagcggtggctcacacctgtaatcccagctctttgggaagccgaggcgggtggatcacgaggtcaggagatcgagaccatcctggctaacatggtgaaaccccgtctctactaaaaatacaaaattagccgggcgcggtggcgggcgcctgtagtcccagctactagggaggctgaggcaggagaatggtgtgaacctgggaggcagtgcttgcagtgtgccaagatcaggccactgcactccaacccgggcgacagagcaaggctctgtctcaaaaaaaaaaaaaaaaaaaaaatcaaatcattctctccctccctggatattatggacaatatcacaggggggtgtacaatgagtttctagaatatatttgaggaggatgacgggcggtgtgtgcatgcttcatggccttattcaattaaacactctgctctcaatttattgctaaatcctccttgagcccttagatttcataacggttgtcgcgacatttttctggatgtagaaaacgttcccatttcttgccaccttatgggctacaccttgacctaaagtttttatgtagatacttgtgcttactctgtggcctttccagggtttgctgaagatggaggtatttaggctgggcaagaggtggtgaggtaaattggggtttatcgattatagaacaggctcctttagagggatataaagcaccgccaagtcctttgagttttaagctgttgcttgtagtgttctggcgaacagttttgttgatctaactattcgagtttagagttaagcatagcggggtatctactcccagtttggatcttagctattttgtcttcagaatattaaaggcaccttagtagttatttcagctggggttttttttacaacttttttacaacttatttagaaactttcaggtttctaaatatatgaatgaaccataatataagcctcggccaatacaatgccagttaggcctcctactgtaaaaaggaaaataaatccctgggctcacagcattgcgggggatcatttgatattaccgccgtgaagtgtagctagcaagtcagctaaaaactttgacgctagtaggaatagcaataattataatagcagaggtgaagcaggctcatgtatccacatctatccctaccgtaaataaacggtgggcccatacaacaaaccgtaaggacccaactgatcctatagctcactctaggcccatatacctgaatggttctttttttttccagaatagtatgttacgacgtgggaaattatcccaaagcccagtgggatgagaatgtagacttcagggtgaccaaagaatctgaataaatgctaaaacaagataggaccacctccgccagccaggtagaaaaaagtagtattaagattgcagtcagttaacaatatagtgatgccggcggctaggactcggagacaaaggagtagaagaactgctgtaattagtactaatcagatgaagaggggtgtgtgatattgggacatggctgggggttttatattaacaattgtggtaataaagttaatagcccctgaagtagaagaaacacctgtcaagtggagtgaaaagatagtgaaatctacagaggcacctgcatgtgttaggtttcctgctaagggaggagagactgttcagccggttccagtgccggcttctactatagtggatgcaagtaataataggaaggagggtgggaggagtcagaagctcatattatttatgcagagaaatgctatatcgggggcgccaattatcgggggactaatcagttgccaagacctccaattatagtattactataaagaaaattatgacaaatgcataggctataacaatgacataaatttgatcatctagtagagttcagctcgaataagacttaaagctgtactgactatccctgctcatgtgacaaataataaatataatgtcccgatatctttatggttggttgagaatagtcaactgtcagccaacataaatgaagtgagaaaaaagggtaaaatgattgagtagggcattagactgtacatctaaaaacagaggtcaacgcctgtttttaccagtcccaaggtgattttcatgttgaattgtaaattcaaagaagcagcttcaatcctgcttctctcaccttttttcccccagtggctggagaagtagattcaaaccagttgactagggagtttagctgttaagttttcatgggtttaagtctcatcaatttagtaaggacttagcttacttaaagtgattgatctgtattcaattgaccaagggtgttctgtatctgagaaagtacatttcagggtcaccatacaacaactgttcaaaaaggcctccaatatgggacagtcctatttattatctcagaaatattcctcttcgctggattcttttgagcattctaccattctagcctagcccctactccagaattaggagggcattgacccccaacaggtatttctcctcttgaccccctggaagtacctctcctggatccatctgtattacttgcatcaggagtttcaattacttgagcccatcacagcctaacgaaaaataatcaaaaacatacaatccaagcactacttgttacaattatattagatatttacttcaccctcctacaagtctcagaatacttcaaagctccctttgctatttctgatggtatttatggctcaacattttttatagctacaggctttcacagaattcacgtcattattggatcaacattcctcagtctgccttctccgccaattaaaataccactactttacatctagtcatcactttgcctttgaagccactgcctgatatcaacactttgtagatgtagtatgactattcttgtatgtttctatttattgatgaggatcttactcttttagtataaatagtaccatgatttccaaagttttgatagcatccaaaaaacagtaattcacctagcattaaccctagtaatcaacaccctattagccctgttactaataattattacattttggcccacaacttaatatatatatgtagagagagaaaaaaaaatatatatatagtataaaataaatatatatagaaaaatctagcccttatgaatgcagatttgaccctctatcctctgcccacattcccttctccataaaattctttctagtagccatcacatttcccctatttgagttagaactcgccctactactacccttactgtgagcccttcaaacaatctgatactaataatccctgcgatatgtgttgtgacttcatacttcaccccccccccggatattacggccaatatcagagtggagtgtgcaccccctgcaatatggggagtgatatcatcctctccccactggatgttatggacaatatcacgggaggttactttctctgggttatggggaaaaatatcctcctgtccccgcctggatgttagacatatttagaggggggtgtccaccccctgtgatatggggagtagtaatatcctctcctgccctggatgttatggacaatatatagggagatgtacaatcccttcgatatggggagtaatatcatcctcttccccctaaacgttacgaacagtatcacaggggggtgtacaccccctgcaatatctggagtagtatcatccccttcttccctaaatgttacagagactatcacaggggtgtgtacaccttctgaaacatgggaataatattctcttcccctctggatgttattatggacaacattacagccgtgtgcaccctctatgatatgcagagtaatatcatcctctttcccccggatgtaagtgacaataccacaaatgggtttacatcccccgtgatatggggagtaatatcatcctctttcccactggatattaacaatatcacttggggatgtacaacccctgtgatatttggaataatatcttctaatccactgaaaattataaacaatatcaccagtgtacactccctgtgatattggaagtaatatcatcctctaatcccctaaaaattatgaacagtatcacaggggagtgtatacttcctactatattgggagtaatatcatcctgtcgtcttctaaatattatgaacaatattacaggggatgtaacactccctgcgatatgtggagtaatatcatcctctccttccctaaatattgtgaacaatatcacaggaggttgtacacaatctgcgatattgtttgtagtatccagtgggaaagaggatgctattactccccatatcacagggggtgtacacccccactgtgatatattcaataacatccagaagtaatattactgacaaaattgcagggggtgtaaactccacctgtgataccattcctaatatcctggggaagagaggatgatattattctcaatattgcagggggtgtacacccaccctatgatattgttattaatacccaggagaggagacaatggtattactcacagtatcaaagaggttgtagagcccccctgtgatagtttctaatatccagggggtgtataccacccttgtgatattgtttctaatatgtagggggaaggacaatgatattactgtccgtatcacagggggtgtacaacaagccccccaggatatcattcctaatatccatgggaagaaagaatattataatatcacagaagttgtacaccccctctgtgatattgttcctaatatcaaagacagaagggtatgatgttcttcccaaaatcacaggaagtgtatacacaccctgtgctatttttcctaatatcgagagtgagagacaatgatacttccaatatcgtaaggagtgtacactctccccgtgataccaggtggggaaatgttgatattactccaaatgtcacagtgggtgtacacacgttttgcaatattgttcctaatatctagtggggaggaggattgtattactcccaccatattactccccacaccccatcatactgttcttaatatccagatttggagaggatgatattactcccaaaatctcaggaggtgtagaccccttctgtgatactgtttcttatatccaggggaagactagatgatagtactcccaatagtgcagggtgttacacgccactccccatgatattgtctctaatatcaagttggggagagggtgatattgctccaaatagtgtaaagggtgcacaccagcactgtgatattattcctagtatccagagaaggagagaatggtattatttttaatatcgcaaaggttgcacaccccccttgtgatactgctcctaacatccaaggggtagaggacgaaattactcccaatatcacagtgggtatacacccccccgtggtattgttcctgatatccagggggtataggatgatagtactataaatatcgcaaggggtgtacaccccttctgatattgttactaatatccgtggggggagtcgatgatattacttccaatatcacagggcatgtacaccccccttgtgatattgttcctaatatcctgggaggagactatgatattactggcaatatcacagggtgtgtgcattcccatgatattgttcctaatgtccagcaagggagaaaatattactcccaatatggcaggggtgtacacttcccatgcgatatcgttcctaatatccatgggggaaaaggatgatattactctaaatgtcgcaggagttgtaaaccgcccctgtgatattgttctcaatatccatggggggagagaatgatattactcccaatatcacaggtggtgtacacccctcgtgttatattattcctaatatccaggttgggagagaaaaatattacaggtaaaatagcagggggtgtacactccgcctgtgatattgttcttaatatcccggggaagagtggacaatattactctcaatatcacaggatgtgtacaccccctttgtgatattgttcctaatatccataggggtagagggtgataccactcccaatagtgcagaaaaggtacagccccgctgtgatatcattcctaatatccagaggggacaggatgatattactcccaatatcacagagggcatacaccccctccccatgatattgttcataatacccagggggtagaggatgatattactcccaatatcgcagtgggtgtacacccaccctgtgatattgttcctaatatccatgtggaaagggtaaaaagttactcccaatatcacaggggttgtacaacccccttgtgatattgttccttatattcgggggagagacaatgatatagctgtccatattgcaggtggtgtacaaccccctgggaatttgttcctaatattcagtggggaagatgatattaattaaaatgtcacggggggtatacaacccctttgtgatattattcctaatatccagggaaagaaagaatattattcccaatatcgcaggggatgtacacccctctctgatactctttctaatatccctggggggagtctataatattactggcaatatcataaggagtgtataccccccgttatattgttccttatgtccagcaagggagaaaatattaatcccaatatggaacagggtgtacacacccatgaggtattgttcctaatatccagggagggaaaggatgatattactcccaatgttgcagtggtgtataacctcctgtgatattgttcctaatatctaggtggggaaagtacagtattactcccaatatagcaggggttgtacaccacctttgtgatattgttctacatatccatggggaaggaaaatgatagtactccccaatatcacaggtggtgtacaaccccttgtgatactgtttctaatatccatgttgggggaggatattactcccaatattgcacgtgttgcacagaccccctttgctattgcttgtactatgcagggtgtggggggagaggatgatattgggagtaatatcaccctctctccccggatattaaaagcaatattcagggtggtcgacacttcctgcaatattgagtataatatcctctaccaacctggatattaggaacaatatcacaggggcatgtacactcccttcctttcaccatatacaaaaatcaactcaagatggatgaaggacttatgtaagacccaaaactatataaaccgtagaagaaaacttaggaaatatcattctggatatagacgcaggcaaatatttcatgatgaagattccaaaagcaattgcaacaagaagaattgacgagtgggacctaatgaaactaaagagcttcagcacagcaaaagaagctatcaacagagaactccctacagaacagaagaaaatattttcaaattacatatctgaaaaaggtctaatacttagcatgtataaagaatcaataagcaaaaaacaaacccactacaaataggcaaagaacatgaacccccacatgcaccatcctcaagtccatgtgcaacttctttctggatgctggacaaggacttgggtaccaagagggcactgaacgggttaacacttaagccgtctgtggattcttttttcaaaagacaacgtatgtatggcaaacaaccatatgaaaaaatactcaacatcactaatcatcagaaaatcagaaccatgagataccatatcacaccggtcagaatggctactattaaaaaatctaaacataacagacggtgccgagtttgtggaaaaaagggaatgcttatacactgctggtggtgatatagaaaggagacagggaaatactgggtagaagagagtggttctctggcaaagccctgcccacaagcctggaaacccatggccctaaatgggaacaggcattcctgcttttgcacccaaaagttgtctttcagctcaccatgcaccccctgtcctgtacccatatatgccccagacctcaggctccagaagcagacaagcagatgaggagatgaacagaagagcagaattgcagaatgatgtggcagaaagaagagaaggagcatctgaatgccaagaggagtttggctggcagtggttggagagatcagcctccggatggcaaagctcccggagaagatcatcttccattccatcccctttccagctccccatccatcccattgagtgccacctccaccactcaataaaacccccacattcaccatcctcaagtctgtgtgcaacttaattctttctggatgctggacaaggaactgggtaccaagagggcactgaacaggttaacacttaagccgtctgtggatggcaaagctaaaagagtgcactgtaacacatgcccacttgggctgtgggagtcgcaggaacccacccctagacagtaccatggccacttgccctgcctattgcacctgcctgtctgcatgctcccctgcccagtaaggggtttgacagcacacacggtggccagacaagccacacccctgttgcacatcctgccaaggggagtcagggaagtctccagtttcatcaggaatgtaaatttgttcagccattgtggaaagcagtttggagatttctgaaataacttaaaacagaactaccattcaacccagcaatcccattattgggtatatacccaaaggaatataaatcattccgtcatagacatatgcacgcatattttcattataacactattcacaatagcaaagacacggaatcaacttagatgcctgttagcagaagactggattaaaaaaatgcagcgtacatacaccatggaatactacacacctataaaataggatgaaataatgtcttttgcagcaacatgaatggagctggataccattattctaagtgaattaatgcaggatcagaaaaccaaacaaacactgcatgttctcacttataagtgggggctaaacattgagtccacatggacacagagaagggaacaatagacacaaggtctactgtgggtggagcgtggggggagagtgaggatcaaaaaactccctattagatactacgttcactacctggatgactacgtaatctgtacaccaaatcccattgacacacattttacccatataataaacctgcacatgtacccgctgaacctaaataaatgttggaaggaaataaagttacaaccaactcttgtactattgtgaggaaacaatcatatgtgttgacaaaaaatcagctactattagatttataatagtatatatgtagcagaaaaatatcagatataacttatatactcaaaagtatgacttaaaaacagcatgacaatctttatgatgggatattgtgcaactactagaagcacattttcagagattatttattaacatatgataatgactacattgagtggtttttagaagcatgaattgaaaccatgtataagcatgactttattgcacttatatataacattacacaaacatttacataattataaaataagtatgctcatgttcataatatgtatttctttatattcatatgtaaggccaataggaagtaatctctgtatctgagttattatttcataaataatttatgcttgttctgtgaaaataaaaacactgctatggatcttccaagtatcctgaaaggataccgtttataattaaacaataacaattttagaaataattattttaaataaggctatgataaatctggtttcattgcacactttaactttggaacatttcatgaagagtcccttgatcacgactctcatattcaggagttttttgagatcaaaatgggacaatcagtatgaatctattttttagacatgcaaatggataactttaaatagcagtagcgatataatcagagtgcacagttgctctgggacaaaacttggaaatgagcatatttttagattcttaatgttttacacactttagaattccacagcaccgttacatactcatttttctactagaataccttggtaaaaattcacagtagagatcaggcttgtccttcatacattaactaatcaagtaggaaagtgcaaatgagaacacagtgccaaacataggcaccacatggaaacaagcatggaactgccaggaagccatttttgtagctttgtagcccaattatatttttcctaatgtattgcacacaaaacttgggggaaaaaaaagaggcagagagaaaacaggttatatcagccctatctcacaatccacaagttcatcctattagaggagtaactatgtaaaacaaattttatctgttgaatgtcctatttagttaatcgcaaaactgtacgagaacacacttgtgacttatttagcagcttgtttgttcgctttccactggcttcacaaatgtcctttggaaatagaatgtacatttggaaccttgtacaccttttctttctccagtaccctcttgtcacttccatcactaaggtgacagaagcaactaggggcaatgcatttgtagcacacctgggtcagaggtatcctccaggggaaggatcagacctgcttgaaagcatgtcgttggaattgggaggcttctagtagctataacataagcactgatgtttactgttccctgccctccattttgatcactctgggaaacgtttttttttttttttttaaatcaattgtattgaaacataattgacataaaataaatactattttaaagtgcacagtttgctgagttttgccaggtgtaaccatccaggtgaataaaattgattaaactgatctttcaaataataaattaactttgcaaacttgctagaaatttaatttgttcacagtttattatccattctatgtactgctacattcaactggttattatgttttaaggacttttgagtctatgtttatgagggataaacatcaaagttatataatgcctttgtctcgatttggaatcggcaatactgggttcataaaataagataggaaatgtccctttaaattttcttttttttttttttttttttttttgagacggagattcactcttgttgcccaggctggagtgcaatggcacaatttcggctctccacaatctctgcctcccagattcaagctattctcctgcctctgtctcccgaggagctgggattacaggtaagcgccaccatggcctgctaattatgtacttttagtagagacggggttttctccatgctggtcaggttggtctcaaactcctgaccccaggtgatctgcccgtcttggcctcccaaagtgctgggattacatgtgtgagccactgtgtccggcccttaaattctatttcttaaaaagagtcctttcaagattgatattatagatactcctcaacttacaattgtcttatgtcttaatgaactcatcctaaattgaaaatattgtaagtctaaaacgcatttaatatatttaacctactgaatatcatgacttagcctcgcctaccttaaacttgctcagaacacttacattatcctacaattgggcaaaatcatctaccacaaggcccattttaaaatattgagtatctcatgaaatttattgaaaactatactgatagtgaaaaactggtcatattgatgctcatcattaatgtacacagatgaaagcaccattatcaagtcagaagagcacaagtcaaaccactgtatgttgaggactctctgtactttcttaaatgtttgatagaattcacctaagaaagcatgtagcctgtaattatagaaatctttttaaattaaaaaaattcttcaatacatagagaagctattactttttctatttcattttgcatcagttttaagaattagttttacaaataatttcccatgttattttaattgtcaaatgtattggcctaaagttttcataattatattgatgtctgtaggttctgtagttacatcctctatttaattcccattatctacattatgtagcttctgtaatttttttcgagataaatcttgctagccattgtttattaaaaaatttttttcaaagaaccaatttgtgggtatattaattagctccaccttttgttatttgctatgttgttggtttacatttttatctttatcatcttccttcttcttaatttggatatactttgctcattttttagcctcttaaaaaagaacctaaaggtcattgattgaagccttttattttcaatatattacatctataaatgtacttttaagaaacgatttatctgcatcccacattttattaagtttttaaaaaattttctttcagtttaaactattttttttgtgtgtgaaacttttcttggccaatgggtttttctgaagtattttgtttaatgttcaaatgttggggtgttattgtacatatcctactgttgtccatctctggttcatgatacaatgcatgttctccattgcacttagataacatgcctccatgtctctggagaattcctcagtctttctaaaatgcttttgatgaatactggcagttattttgtagaatgtccctcctcaatttcagttagtctgatgttttctcacggttaggactaaagttatacattttgtctaagaataccatagaattgatgttttgtcctactcagtgcatcatataagaagttacatgaagttcatttatcttattattagtaatgttaactttgatcacttggctaagttgacatctccactttgaagttactattctataattatcttgtgggaagatactttcatattatgcaaatatgttctttcccaacatatattcaccactaatcttagcatccctccaaggttctttcttgcaacaattattactatgatatttgcaaagtgatgattcttatattttatgtctcctacatttaatgaaatcttactgtaataaaatactacccattctcaatctttggtttattatttatgtcaatatggatttttttttgagttggagtcttgttttgtcatccaggctggtgtgcaatggtgcgatttccgctcactgcacttccaccttccgggattcaagccattatcctgcctcagcctccggagtagctaggactacaggcatgtgccaccatgcccggctaatttttgtatttttagtagaggcagggattcaccacattggtcaggctggtctcgaactcctgacctcaagtgatctgcccgcctctgcctcccaaagtgctgggaatacaggcatgagcaaccgcacccggcatggattaattgaaaattttcttctgtagattgtaatatattactattgttatctattttattgccccaattttctcaaatttggctatggaagtttattcaaagtggatctgtttccctttcacattttccccattttgtgagcatttccttacttcctaacatgacaaaatatttcaaactaatcttgtattttccctgcccgatcctgatatcaaatatgtccacaaggagccttggttcctttaattggagagtggtgttctcattgttactgggatgatgttgtttctaggcccttttgttagaggagctagaaaatatatgtatgtatactcacacatttatacacatctgtacttatttatacaattatccatctgtacgtatactaaaaacaatgatttcatgaagcttttgatcccaatccaacactagataaagactatataggcccatttatttgcaaatcatcacataaacatagaagaattattaacaatataagctgtagcttatgctaaatgttgataggaacagacaataagttatggagaacttcagaggacactaaggttggatgggattttggaagttgtacaggtcaatgccactccatctattggctgagtttcactaggttaatacatgaacaacaacaaaaataacctagatcagaagttaaagatcattttattgactatctgccgtgtctgtgccattgcagtgtactaggtgcacttacgagtcctctacttacaaactgcttttcacaaaatatgaaactccaggcaaaggttcagacatacgacgtttgtttttaaaatctttctacagccttgtatcctttttcctttccttcctttcaccctttttaaaatgtgttatgagttttatcttagactaacatcatctgtaatgttgctatacgccagtattcagttgctgtgtttgatgaatcataaaatggtgtaaaacttcaattagtgtactttttaaataaagtatctatgaatgcatccagcaaaatgtttatgatttgagtattcacaaaatattacttttctctggatctaacaataatgtgaaaacccaaaatgaatataaaatgttagctaataatagatttcaaagtattctacaagtacgaaaaatatatgatattgttactttcatatatgtaaaacactaataatttttgtcaacataaacatcatttttacacctaaacttgtattaattcaattaagagttaatatagtatcctaaagtcatcaaatattcaaaaataggatgtattctgacttggaatatacataaaattacctattttcagctgagcacagtggctcatgcctgtagttccagcactttgggaggctgaggtaggcagattgcttgagatcaggagtttcagaccagcctggccaacatggtgaaaccctgtctctatcaaaaatacaagttagccaggcatggtggaacctgcctgtaatcccaactactctgaaggctgaggcaggagaatcacttgaacccaggaggcagaggttgcagtgagccaagattgcaccactgcactccagcctgggtgacagagtgaggctccatatcaaaataataataataataataatagtaataataataataactattttctgtgagtccaaagataaaatagcattacagaatacctaataatcctgagtttggttttcttggttttattttttcatttagttttgttcactttgaccagtgggctggtggttcttaggtgcatcaaggttttcatttttcagttcaagatttgaaaaccttaatgtggtaatttctctaattgttttgacagttacgtcccaggttgcaagttaaaataaaattcccattttactaaagtccttggtttattaatgattttataatgacttaatatataatttaatgagtaatgaggggtactacatttcagaaatcaacactgaagaacttattcatggaaccaaacaccacctgtttctcaaacacctattaaaataaaaatacatataaataatttttaaaaataaacactaaaaataaagtgaaaatgaaaaaatatatatccaggttaaaaaaaaaactacttcagttaaacaataaatactttttggggggactcaactctactacaaaattattcgttgtttattataatcaataatacaggtaaaataataagtttttaaaaatggaaaaattgtaaaaaataaaacgatattaacaaatattggtatactggtgaaggccgggctcagtggctgctttccaaagtggttacaccagtcgggcatggtggcacacacctgtaatctcagcacttccggaagctgaagcaggcagatcacttgagctcaggagtttgacacaaacctgggctacatgacaacaccccatttctaccaaaaactgtaaaaatcagctgctcatgatagcatgcatctgtaagtgccagctacttaggaggctgaggtgagaggatcacttgtgcctggaaggtcacagctgcactggccatgttcatgtcactgcactccagcctgggcaacagagcaagattttgtctcaaaaaaaaaaaaagttggtgacaattggaataattggaactcacatacattactggtgggaatataaaatggtgtaatcaatttgggtgttttcttggcatttgatttttttaaaaaatcaagatattgtttccctatgttgcccaaggttgtcctgaactcccgagctaagaaaatcctccaaactcagcgtctcaaatacctgagattaaaggtgtgagccactgtgcctgaccagtgtaaccactttgaaaaacaacgtggcagtttctcaaagactaaatgtatagtaatcacataatgcaacaatttcactcctgagtgtaaatccaagagaaataaaaatatatgttcacactaaaacttacgtacgagtgttcataacagcctgactcatgatggtgaatactcaaaaacaacacaaatgtccatcaactaatgaatggataaacataaactattactcagctacaaaaggaaagaaatcctgatacacactataacatgatagaaatttgaaaacattctgctaagagaaaaaaaagcaaattacaaaagatcacacattgtacaattctatttctataaaaggtccagattaggcaaaactacaatgacagaaaataaatcactggttgcctatgaacatggggtacgtaggaggtagcggctaagaggtgagggtttctcactcataagtgggtaactcacaagtgggtgatcacttctaagaaagactgtggtgatggatgcacagctccttgaatattctaaaaaccactcaattgtatactttcttttttttctttagttatttaaagacggtctccttttgtcacccatgctgtagtgcagtggtgccatctggtctcactgcaacctatggcttctgggctcaagtgatcttccagtctcatgtccccaagtagttgggactacaggcatgagccaccacaccagctaatttttgtatttttgctagagatgctgttttgccatgttgcccaggctagtcgcaaactcctgaacacaagcgatccacctgcctcagctgcccaaagtcttagcgttataggaattagccactgcacctggcctgaattgtgtactttgataaatgaattgcatgatacgttaatcatatttcaataacgttattattttaaaaatggctgggcatggtgtggtgactcacgcctctgatctcagcacactgggaggccaaggtgggtggattgcctgatttcaggagttcgagactagtctggccaacatactgaaactctgtctctactaaaaatacaagaatattagctgagagtggtgacatgggcctgtaattccagctagtcgggaggctgaggcaggggagttgcttgaaccagggaggtggaggttgcagtcagctgagatcacaccactgcattccagcctgcatgacagagtgagagtccatctccaaaagaaagaaagaaaaagaaaatgggcattgaacacaggtggctcccacatacatataatccaagcactttgggaagctgaggcagaatgatcacttgaggccaggagtctgacaacatcctgagcaacacagcaagatcccatctgtacaataaaaaataaagaagttagctgggcataggggcaaatatatgtagtcccagctacttgggaggctgaggtgggaggactgtttgagtccagggtttcaggctgcagtgaaccatgatcatgccattgcactgcagcctgggtgacagaacaaaaccctgtctctagaaagaaaaaaaaagaaatccaagtttttatcaccttctgagagtaatcaacattcaggagaaacacacaagaacaaaagaccactgaatggttgagggtgggttgctggttaggttcagtggccagctgagtagtatctgaaaaattcattagtaaaattatggcactaggggtgagtcatgcagtcgaaggatgaatactaaatccagtacaaacacccatggtctttctttacatgaattccagtgaaaaatttctaagtgcctaaaatagcaagtggtctgaaatgatggcagcagtttattaaagactgaaaaaagaggccaggcacggtggctcacacctgtaatcccagcactttaggagtccaaggccagtggatcacaaggtcaggagttcaagaccagcctgtccaacatgctgaaaccccgtatctacagaaaatacaaagcttagccgggcatggtggcatgtgcctgtagtcccagctacttcagaggctgagacaaaagaaatgcttgaacccgggaggcagaagttgctgtgaattgagattgtgccactgcactcgagcctggtgacagaggaagatgctgtctcaaaaaaaaaaaaagaaagaaatggcatcttcaagaaccacaagagagttccacactgaagaagctctgattctgcatttgctgaactactgatttgagttagccaatataacactatcttagataaagtgtacaaacaactcaatttcatctcctcattaataactgattagtctaatatcaattctgatttttaaaaagctaattagaaaaagaattaattatagaaccaataagaggtttgaatagttacaagctattcaaaggagaattcaaaaaaccactcaggtatgaggccataaagtatgatgaaataaatttcattaatatattttaaaataaactgattagacaggcaacaacacctgggcacgggtctcctcacctccagcaacacaaacccaatcgcgcagctatggggttgcaaaggctgcatagtgacaaacagactgctctgagctgagatttctttacttgtatctgtattctgagaccgggtctcactctgtcactctggctgcaatgcaggggtgcactcatagctaactgcagctgtgacctcctgggctccggggatcctcctgcctcaccctcaccatagctacggctacagatgaacaccaaaacacccagctaatttttttttttttttttttttttttttttttttttttgtagaaagaggagccttgctatgttgcccaagctggcctcaaactcccgccctcaagagatctgcccacctcaacaacctaagtaacaggttctacaggaaaataccactatgccgggataattatattttattaatttttatttgcgtacacaggaagtcttgctgtgttgcccagggtggtctcaaactcctggactcaaaccattctcccatctctgcctcccaaagtgctgaagctacggacataagccactacacctggcccgacttaagatttctgtaatctagcatcccatacttcatataattgggaaaagcagtagtggtttttttttaattacttagcatttcaacaagaatcaaccatctctcaccattgccagggacctggtcagaaccacaatcatctccctcctggaggttgccacagcatggcctccctgcttctacccaaatcttcccacaatctttctcaactcagctgccatgggatgcttttaaatcagtagacagttcgtgtcacctctctgctcagaacccttctgcatctcccatctcagacagaataaaaaccaaagccccagcaatagcctcccagggcttacacaatctgtactgatctgagtccaacaactccctggcctccttccctacttctctccctctctctactccacagacctctttcctgagcttcagacacaccacggagttccctcttagcatctttattctgttgtttctgcctaaaatgctcttccctcagtaccttggccagctccttcccctccttcaagtctttgctcaattttcacttaggaggccaacctgaccactctatttaatattgctatctgtccctattcctgccatactcactcatttcttttttctatttttttctaagatataatctcgctgtgtcactcagactggggtgccatggcacgatcacaacgcactgagacctggagctcctaggtcaagaaattgtcctgcctcagggcctctagtagctaagactacaagtgcatgccaccacacccgctaatttttttttttttcatgtagacagggtatcattttgttgcccagacttatcgtgaactcctgggccaaagcaaccatcctgcctcagcctcctaaatagctggaattataggtgtgggccaccaattctggcttcgtgttcatttcttcttgccgctgttacaaactaccctacattgagtggcttaatacaccacaaatctactcactaagaggtctgggggccagaagtccaaaataggtctattaaggctaaagtcaaggtgccagcaggactgcatcccttctggaggttctggagagaatatgttcccttgcctttcccagttgctaaagccactcctattctttggctcatggcccctaactgcatcttcaaagcctgaagcaaagcatattcaaatctccctctgtgacctgtgcttccatcatcaaatctccttcaattcggactctcttacctccctctttcacttataaagacctcttgtgattgctggacacagaggccgtggctcacaaccataatcccaacagtttaggaggtcaaagcaggagaaacgcttgaggccaaaacttcaggaccagcctgggaaacacagcgagaccccctcaattaaacaacaaaaagaaataagaaaaaattagctgggcatggtagtatgcatctgtagtttcagctacttgagaggttgtggtgaaaggatcgctttagccccagagttcaagaccagcctcggcaatataacaagatcctatctctacaaaaaatacaaaaattagctgggcatggatggtgtgcacctgtagtcccagatgcttggaaggctgaggtggtagaattgcttgagcacaggtggttgaggctgcagttagctacaacaccatcactgcactccagattgggtgaaatagagactctgtgttcaaaagaaaaagaaaagaaatacacatttggtttctgcccctcatcctggcaaagagattctcaagctcttataaaggccttggtgatgaaagtgatgaggcatcttctgtttcaatatttggtcttagtcccaggtttctaacacaagagcctctaagacctttgggatcaccatagtaagaatgcatttggtgatgttactgagatgactgggtgactgaaagcttgtagacagcttcagaaaaaggggtggttgttgtcagaagaacaaaccatgtgattagaggcttggaactgtcagcctcaccccctgggctccaggaagaaatagtggccgaagactgacttaatcaccaatggtcaatgacttcaccaatcatgcctgcataatgaagctttcataagcgccctcaacaactggagttggagaatgtctgtgttgctgaacacaagggagataccaggaatgtaatatgcacaatagaggacatggaagttctatacccctctcgacataccttgccctgtgtgtgtgtgtttttttttttttttgagacagagtctggctctgtctcccagcctagagtgtcatggcacaatcgtggctcactgtgacctatgcctccctatctcaagccccatcctctcatcctctcacctcagcctcctgagtagctagaattataggcactgagtagctagaactatagataactgtgcctggctaatttttagaaaaatctttttgtagagatgcattttcaccttgttacccaggctggtcttaatctcctgagcacttaagcaatgctcccgcctcagtctcccaaagtgctgaaattacaggcatgagccactgtgcccagcatgtacatctctttcactgtctgtttctgagatttagcctttaaaatgaaccagtaaaagaaagtaaattggtgagatgcagtggttcatgcccataatcccagcattttgtgaagttgaggtgggaggatcacgtgagcccagaaatttgagaccagcctgggcaacataacaagaccccatctctacaaaaagtaaaagaacatagccagatatgctggtacaggcctataatctcagctatttgggaggctgaggtgggaggatcacttgagcccaggagtcccatgctacagtgagctttgatcacaccactgcattccagcctggcaacagactgagaccctgtatctcagaaaaaaaagaaaacaatctgtttttctgagttcttcaagcaaatgtccgagcaaatgattccacccaccaatgggggtcatgaaaccctgttttctaactggttggtcaaaactacatgtaacaacccaagacttgcaattggcatgtggagtgagggtagactcctgggactgagctcccatcctgcagggtctgcactaactccagggagtgtcaggatggaattgtaggatacccagttgggatccagattgtctgaaaatcagtgtagaaactccacatgcacatttggtcagaggtgtttgaccgtaactactattcacgaaaaaggtctactcattagaactaaaaatcacaaaattgtaagttctacaaaaacaaatcaaccttatctaccgcccagtcctaccgaactatagaatgtgagaacagaaggtctgaccatggagtcgagagctgacaggaatgtcaccaccatcctgctctccaaggactcctcatcttcaacagactcctcatcttcaatgggcagggtggaaactgcaacttgtgccatgatccttgcacaagaaaagtagtaagaaaatgagtggtagaaatccagtgtcctaaactcacatccagagctgtgagagttttttactggctggataattcacagttttcttgaatcaggggaaaaataagactcagaaactaggaattcgttttgcccaaaactctcatcagatacagaatccatccgctaactatctagtattatttccataagttagatcaattatcactcccaaaacaaatgcacatggcacccagaatctgtgcatttctccaaagtaaaagaggaggtggacgggcgcagtgtctcatgcctttaaccccagcactttggaaggccaaggtgggtggatcacctgaagtcaagagttcaagaccagcctggccaacatggtgataccctgtctctactaaaaataaaaaaagttagccaggtgtggtggcatgtgcctgtagtcccagcttcttgggaggctgaggcaggagaatcacttgaacccaggaggctaaggttgcagtgagcagagatcgcaccactgcacctcagcctggacgacagagtgagactctgtctcaaaaaaaaggaggggaggaaaggaggcaaggcactttacaacccagtgatgagctaccacaactcaacacagcaaagagttgccaagctccctttctcccttgcacaaccagacacagaagagttggtgcagtggaatgaggctggatggagagaagttcttcttctttctttccttttttttttgagatggactctcactctgtcacacaggctggggtgcagtggtgcaatctcggtcactgtaacctctgccttatgggtttaatcaattctctgcctcagccttccgaatacctgggattagaggcaccccccaccacacccagctaattttttttttttttttttttttttagtggagactgggtttcactatgttggccaggctggtcttgaactcctgacattaggtgatctactcacctcggtctctaaaagtgctaggattacaggcatgagctgctgtgcccagccaagaagttcctcttcttacttagaaaacagatcacagggcatcaagtaacacgtaaaatcctctataataagcagcattatttttggaaaacctttcctaatattttggtatcagtgaaaagcctcagattaatttcaaacactataaaaatacaatacataaacagaaaatattaactgtcagcaatgctatagagaaattggaagctgtatgcattgctttatggaatgtaaaatggtacagcccactgtggaaaatggtttagcagctccttaaaaatatgaagcatagaattatatgatccatcaacaccctttaagcatatatacccaaaagaactgagagcagggactcaaacaggtatttgtacacccgattaacagcagcattattcacagtggccaaaaggtagcccaaacctaatgcccatcagtaggtgaatagataaagaaaatgtaatatatacatacacagagtattattcagccataaaaagaaaaatatctggccagattcaggggcttacacctgtaatcccagtattttgggaggccaaggtgggcaggtctcttgagccccatattttgagaccagactgaacaacatggcacatttggttagaagtgtttgaccataactactattccagaaaaagatctactcattagaactacaaatcataaaattataagttctacaaaaacaaatcaaccttatctaccacctagttctaccaaattatatcatgttagaacagaaggtctcaccgtgaactcgagagctgatatgagaaatgtcaccaccatcctgctctccacggaatcatcttcaacagactcctcatcttccatggactcctcatcttccatgggcagggtggaaactgcaacttgtgccatgatccctgtgcaaaaaagtagtaagaaattgaatggtagaaatgcagtgtcctaaactcacatccagagctgtgagagtttctcaccggctgccaaattgttttttgggtcagagaaaaaaataaaacttggtaacctggtactcgacttgccccaaactctcatcagatagagaatctatccgctaactttctatctagtattatttccatgaagttacatcaatatcactctcaaaataaatccaggtggaagactaaatccaaagctagcagaaggaaagaaataataaagagcataattagagcataaatcaataaaacagaaggttggagagcagtagaatgaaaaaatgtagattctttgaaagatcaagcctttcactatattgactgagcaaaagatggaagactaattattaaaataataaatgaaagcagagccattactaccaactttatagaaatacaaaaggattacaggagtatactgtgaacaactgtctagcaacaaactaggtgccctggatgaaatggatgaatcgctagaaagacacaaactaccaaagtggctcaagaagaaagagaaaatctgaatagacctataacctaggagattgaattagtaatcgaaagcgattaacaaagaaacatttatgaccaaatagctgcattaactggtgagtcaacctaacatttaaagaagaattaataccatttcttctcaaactcttctgacaaaatatatgaagaaggaatacttgctaattcattttttgataacagcattatccttataccaaagacaaagagagcacaaaagagagaaatacagcactatatcccttatgaatatataagcaaaaatctcagcaaaatactagcaatactagcaaaatactagcagcagcaatactgtataatcaaaggattgtaaactatcaccctttgagatttatccccaaaatgcaagggtggttcaacatataaaaaatcaatcagtgtaatatgctgtaacagtaaaatgaataagcacgtgattatttcaattgatgcagagaaaacgttgatgaaatacaacacccttctataataaaaatactcaataaactaggcatagaagggatcttctgcaacatgacaatgggatgtacaaaaacccaacagttaatatcatgatcagtgatgaaacactgaaagctgttttcctaacatctagaagaaaaggatggtgcatttgccacttgtattcaacgtagcactggcagttctagccagagcaattaggcaagacaaagaaataaaaggcatctaaattagaaataaaaaataggtgtaaaattatatctacacatgatcttatgggtataaagctccaaacaaaacacaaaaccgattataactaataaaagaggcaggatgcaaacaaacataggcaaatgagctatatttctatatagttgtaaagaactatgaaaacattttaaaaattccatttataatgacatcaaataatacgttattcaggcatacatctaaccatggtggtatacacaaaacattgctgcaaaaaactaaagagagtggaaataagtggaaagacattctgtgttcacgggttgtaagacaatattgttaagatgacaataccatctaaagtaatctacagattcaatgcaataccatcaaaatcccaaaggcatttttgcagaaacaaagaaactcattctaaaatcatacaaaaattcaaaggatctgacagataaaacagtcttgaaaaagaacattggaaaactcacatttttcagtttcacagcctactacaaatctacagtaatcaagagagtgtggtactggaataagaccaatagactttcagaccaatacaatagaacagatttgagatcctacaaattagtcctcacatatatggtcaatgacggttcaacaaggtggccaagtctagtcaagggaggaaagaacagtctcttcaacaactggatgtcagtgcacaagagagaagttagacccctactttgcagtatatacaaaaattaattctaaattaataaaagacttaaatgtaaggactaaaaatatgtaactcttagaagaaaacacatggtaaacctttatgacctttgagttttaagcgtattttgaaatatgacagaaaagcacagataacaaaagaaaatacacgaaaattagatttaatcaaaataaaaaaccctttatgtatcaaagggtactatcaagggagtgaaaagacaacccataatatgtgagaaaatatgtatctgataaaatcaaaatgtgtatctgataaaagcttaatgttccacaactcaacaacagaatttctaagatcccaattaaaaaataggcaaagtacttgaatagacatttctccaaagaagatacacaaatgtctaagaaggaaaagaaaagatgctaaacaccattattcattaataaaatgcaaggcaaaacccaaatgagatgccactttgcatccactagtaaggctttcataacaacgacacagaaaatcaatgttgctaaggaggtggagaaactggagccctcatgaactggctgctaggaatagaaaatgatgcacttgctgtggaaaacagtttggtggttcctcaaagaatcacacagagaaacaggcgccgctggcttgcgggttctcctgggctggcacgggacgtcccggaatcgcaggccagcactccttcccgcctgagggtccgtctggccgtgactcccgcccctctcctcctccgaagagagatcggggccgccccaggggccatctgcagccacaggggatggggctgagggtcggttcctgccctggtgcagccgcccctgtgcagaccgcctggcttggtcgcagtcatggtgacatctagccccggttctgcgaggctgggcgcgccagccagcttgggagtcgcccggcgcctgtagctgggcgcccaggtggtggagcatgccctgggcggcctctggatcgcgggtgcccctggcctgagagcctgccagaccctgccccggcccggctcctcccctgtcagagctccagatctctatccaggggccctctgcagccaccggggatggggctgagggccggttcccacccctgtgcagctgctgcagtacagaccgcctggcttggcaacagccacagggacatttggccctgcttccaagatgtggggagtgtgggcgggctcgggagttgcctggaggctgctgcctgcacgcagaaggcggctgcagctcgggtgcccaggcaggctggaggtgcatggcctggtcggccttgggatcgccagcgcgccaagactgagggcccccaggccgtgcctcctgaccactcctccacctgagggagatcggagccgtttatatgggcactcggcagtcacctcgtgtggggttgagcggtgggttctcagttctcgctcctgtgcagctgctgccgcagggcagaatgcctggcttggctgcagccactgggacacgtggccctgcttctgtgatgctaggagcgcgagcgggctcaggggttgccaggcaggtgctgcctgcacacagggggcgacggcagcttgggcgcccagatggcggagcatggtttgggtggcctctggaatgcgtgcacgccaggcctgagggtcaccctggtggggccacataccccggtcttcctctgctggagcctggagcagctggaatggccactattccgtcacaggggatggagttaagttttcttatcccacccatgcacacaaaaaggtgactattctgtgaggtaataaacgtgttaattgacttcattcatgccactctgcatccacaagtaagggtttcataacaatgacacagaaaataaatgttgctaaggaggtggagaagttggagccctcatgatctggctgctaggaatagaaaatgatgcccttgctgcggaaaacaatttggttgttcctcacagaatgagcattgggtgaaaaatgaaatcaagatggaaatgtaaaaaatgtcttcgaactggatgacacaacctatcaagacctctgggatacagcaaaggcactgctaagagcaaagtttgtagtcctaaaaacctacatcaaaaagtctgaaaaagcacaaacagacaatctaagttcacatctcagggaactagagaaacaggaacaagccaaacccaatcccagcaaacacaggaaataacaaagatcagagcagaactaaatgaaattgacacaacaacaacaacaacaaatacaaaacataaataaaacaataagttggttatttgaaaagataaataaaattgatagaccattagcaagattaaccaagaaaagaagagagaaaatccaaataacctcactaagaaatgaaacaggggatattacaactgacaccactgaaatattaaagattattcaagggtactatgaataccttttggcacataaactacaaaacctagaagagttggataaattcctggaaaaatacaactctcctagcttaaatcaggaagaattagataccccaagcagaccaataaagcaagcagcaagattgaaatggtaattttaaaattaccagcaaaaaaagctgagggccagacagattcacagcagaattctaccagacattcaaagaatgtcttctttcattcaaggaagaaatgataccaatcttttcatactattccacaagacagagaaagaagaaaccctccttattcattctatgaagccagcatcaccctaataccaaaaccatggaaggacataaccaaaaaagaaaactacagaccgatatccttgatgaacttagatgccaaaatccttaacaaaatactatctaactgaatccgacaacatatcaaaaaataatccaccatgatcaagtgggttttataccaatgatataggagtggtttcacatatgcaagtcaataagtgtgatacactaaataaacagaatttaaaaaatctaatatgattatatcaacaggtacagaaaaaaacatttgacaaaatctagcattgctttatgattaaagctctcagcaaaataggcatacaagggacataccttaatgtaataaaagccatctatgacaaacccacaaccaacataatactgaatggggaaacggtgaaagcattcactttgagaactggaacaagacaaggagactactctcaccactcctcttcaacatagtactggaagtcctagccagagcaatcagaaaaaagaaggaaatagaggaaatccaaatcggtaaagaggatgtcaaactgtcacttgttgctgatgatataatcttttgcctagaaaaccctacggactcctctagaaacttcctagaaccgataaaagaattcagcaaagtttccagatacaagattaatagacacaaatccgtagctcttccatacatcaacagctaccaagaagagaatcacatcaagaactcaaccccttttacaatagctgcgacaaacaacaacaacaaaaaaacaaaacttaggaatatacctagcaaaggaatcaaaggacagctacaatgaaaattacaaaacactactgaaagaaatcatagatggagccaagcacggtggcacacgcctataatccgagctactcgggaagctgaggcaggagaatcgcttgaacccgggaggcagaagttgtagtgagccgagatcacaccattgcactcccacctcagcgacaagagcgaaactccctctgaaaaaaaaaaaaaaacaagaaagaaaagaagtcatagatgacacaaacaaatggaaacgcatccccatgctcgtggatgggtagaaccagtattgtgaaaattaccattctgttaaaggcaatctacaaattcaaagcaatccccatctgaatgccaccatcattcttcacagaattacaaaaacaattctaaaattaatatggaaccaaaaaagagccatgtaaccaaaccaagcctaagcaaaaagaacctggaggtatcacactacttgatttcaaactgtacaataaggccatagttaccaaaacaccaacgtactggtttaaaaataggaacatagaccaatggaacagaagagagaacccagaaattaacccaaatacttacagccaactgatcttcgacaaagtaaacaaaaacataaagtggggaaaggacccccttttcaacacatgatgttgggataattggcgagccacatgtaggggaataaaactggattctcatctctcatcttatacaaaaatctactcaagatggattaagaacttaaatctaattcctgaactataaaaattctagaagataacactggataaacccttctagacattgacatacgcaaggatttcaagaccaagaacccaaacgcaaatgcaataaaaacaaagataaatagctgggacttaattaaactaaacagcttttgcatggcaaagggaacagtcagcagagtaaatggacaactcaaagagtgggacccctgaacctgaccctgacccctgaccctgatccctaacccctgaccctgaccactaacccctgaccctaaccctaacccctaaccctaacccttaaccataacccctaagcctaacccctaaccacaaccctcaccctcacactaatccaaccctaaccccttatccctaacccctaacctctcttaacctctaactctaaaggttgactcttaactcttaactctgacctcaacccctatctccaacccctaaccctaaacttaacccctaacccctaaccctaacaccaaccttaaccctaggttcgttactacgtttgtactatgtcaatgttgattattatgatctctgtcttaggactgcatggcagcaaggggatttcggatcttatattaatatttttgtattgaggcagtgcattagcattacagttgcttgttacatgagcaatgggggtgtcatattttgggtgtcatgtctgcattaggaatgctgcatttgtcttctgaggctgcggtgtggatctcgcactgtggctgccttggcttggctggggagaacctccgttggcaggattcagaggggcttttggtttcccttttccacactgagcccttctaactggtctctgaccctgattattcagggctgcaaaagggaaggattttattcaccgtctatgcggtcccaagttttcccaaagcgaggcagtgccccaaaggtctgtgctgaggagaatgctgctctgccttagcggtgtcccccgggtctgtgctgagcagaacgcagctccgcccttgcggtgcccccggcccgcctgggtctgtgctgaggagaacactgctccgccttcgctgtatctctgaagtctgtgcagaggagaactcagctccgccctggcgatgctctccttgtctgtgctgggaagaacacagctccgccctcgcaaaggcgcacagcgccggcgcaggagcagagaggcccacagcgctggcgaaaggcgcagagaggcccacagcgccggcgcaggcgcagagaggcccacagcgctggcgcaggcgcagagaggcagaaggcccatgaggggaaggtgagacacctggggcaaagaagaaaaaaaaatgcgccgcgaagcggtgtctgggtcatccagggacgaaagttttttcccatcagcccttgcgctgggccccagggacccgggcatccctggttcacgcccagggtgtgcctcaggcgactaggggtaccccaacttggacagaaggcccgtgagtggaagttgaagtttgtgggaggagagatgaggcaccaggggcagaaaaaaaaaaaaagaggaccgcgtctcagagaagcggggcctaggtcccccacggatgaaagtgccttcccatcaggccctatgctgggcctggtggaccctggcgaccctggttcaagcccagggtgcgcctcgggacagcttggggtaccacaaagcgaacaaaaggtccatgaggggaaggtgaggcacctgaggcagagaaaaaaaaaaacgctcagccgagaagcagtgcctgggtcccccacggatgaaagtgccatcccatcagccccttcgctgggccctggggaccctggcgtccctggtttgaccctggggtacgcctcgggacagtaggggtaccccaaggtgggcagaaagcccctaaggggaaggtgaggcacctggggcagagaaaaaaagaaaaacttcgccgcggagaagcacggcctgggtgccccacagacgaaagtgtcttcccatcagtccctgcactgggacccagggacactagtgtccctcgtttgagctcagggtgtgcctcggccgctaagtgcaccccaaggggggctttggggacacaaagcccgtgaggggaaggtgagttttgagggaggagaggtgaggcacctgtcacagaaaaagaaaaaaaagaaacccgcgccacggagaggtggggcttgggtaccccacggatgaaagtgccttcccatcagcccctgcactgggccccggggaacctagagtccctggttcaagctcagggagagcctcgggccactagtggtaccccaacgcggtggaaagcccatgagaggaaggtgagctgtgagggaggagaggtgagacacttgtggcagaaaagaaaaagaaaccgcgccacggagaagtggggcctgggtctcccatggaaaaaaagtgccttcccatcagtccctgagctgggccccgtggacccaggcgaccctggttctaggcctgggtgcacctcgggcccgctaggtgtaccccaaagcgggcagaaggcccatgaggtaaaggtgaggtttgaggtaagagaggtgaggcacctgcggcagaaaaaaaaaaaaaaaccgtgcggaagagaagcggggcctggttctcccacggacgaaagtgccttctcatcagcccctgccctgggccccctggactctggcgaccctagttcaaggaccagaagagactccggcatgctagggtaccctaaggaagccagaaagcccacgaggggaaggcgagatttaagggaggagaggtgagtcacttgtggcagaaaaaaaaaaaaaaaatatatatatatatatatatatatatatatatatatatatatatatatatcagtacctcggagaagccgggcctgggtccccactgatgaaagtgccttcctgtcagcccctgcgctagccccgagaacctggcgaccctgattggagacccggcagcgcctcgggcctgctcgtggtaccccaaagcaggcagaaggccaatgaggggaaggtgaggcacctggggcggagaaaaaaaccgcagctttgagaagcggggcctgggtacccacggatgaaggtaccttcccatcagcgcctgcgctaggccccggcgaccctggcatccatggttcgagtccagggagcgccttgggccgctaggggtaccccaagtcgaacagaaagcccatgatgggaagttgacgtttgagggaggagaggtgaggaacctgtggcagaaaaaaaaaaagaaaacaagccgcgcctaggagaagctgggcctgggtcccccaagagtgaaaatgccttcccatcagtccctgcgctgggccctgtggacgctggagaccccggttcgagccccgggtgcgcctcgggcctgctaggggtaacacaaggcgggcagaaatcccatgaggggcagttgaggtttgaggaaggagaggtgaggcacctgtggcagaaaaaaaaactgcaccacgaagaagcagagcctgggtccccaacggacgaaagtgtcttcccatcagcacttgcgctgggcccaggggaccctggcattcctggttcgagaccagggtgtgcttcaggccgctagggatacccaaaagcaagcagaaggcccatgaggggaaggtgatgcacgtggggcagagaaaaaaacaacaaccgtgccgcggataagcggggcctgggtcccccacagaagaaactgtcttcccatcagcgcttgcactgtgccccggggaccctggtatccctggctcgagcccagcgtgcgcctcggcctgctaggggtaccccaagacagacagaaggcccatgagggaaaggtgagacacctggggcagagaataaaataaaaaactgcgccgcccagaagtggggactgggtcccccatggacgaacgtccctacccatcagccctgcactgggccccggagaccctagcatccctgcctcaaaacaacggtgtgcctcgggtcggctaggggtacctcaaggcgggcagaaagcccatgacgggaaagtgagggactggggaaaaaaaaaaaaaaacgccacagagaagcagagcctgggtccccgaggaagaacgtgtcttcccatcagccactgagcttggcccagtggaatctggcttccatggttcgagcccagggtgtgcctcgggtcgctaggtgtaccccaaagcgtgcagaaggcacaagaggggaaggtgaggcacatggggcagagaaaaaaaaaaacctgccgcggagaagcggggactgggtcttccacacggacgaaagtgtctttccatcaggccttgcgctgggcctcagggacactggagtccctggttcgagcccacagtgcaccttgggccgctaggtgtaccccaaggcagacagaaggcccaagaggggaaggtgagatttgaggaaggacaggtgagggatctatggcaggaaaaaaaaaccgcgccacggagaagcagggcatgggtcccccacagacgaaagtgccttcccatcaggccctgagggtttgagacagaatgaggagtgactaatgtctacagggtttttctctggtctggggtgataagacgttctacaatggattgtgaattaaaattgaatgtgcacaaccacaggtatactaaaagccactcaattcatgacttttaatgggggtatcttatgtggcgcactctaatggagaccacggcagacatagtgagagagaaaaaggtgagtaaatatctgaaacggaggcagaaacagagagaatgaaaagccctgtgaatggaagggagagcgaaaagggaaaatggtcctatttacaaatgacagatgtgaaaccggggttcacatcaacagtgtcactgccaggaaggagggtcatgctagccatgtcaccggtagtgtggcccgcagggacgccgacctgctggagcgtcgtgccagcatgggctctggcagccacgtgggccagcaggagggtcctgctgcacagctgtggggtgaggatagactgggtggtgatatcggccattacaggggactcttctgctggcaagagtgtgacagtagcaagtagatggacaggcctgcgtgtgaggaaggaatgcaggaggggctcttgtgcggctggttgtggggccctcaccggaaatgtggagaaatggccaggtaactgcgtcatgtgggctagtagattggccagggcttcgaactgaaggacaataacggggagtagctgtcaggccctgggagtgtctgagtgtaagtggagatgggtttggggtcactgagggatgcgtgggagccatccctgtataggtacaggtcatagggagatagtctcgtgaggcctgtgagtgtctagggttgtcctgggtgcctggggctgactgtggtagaaatctggggaaggctggagagaagctgggagacccaggagagtccctgaaggcagggggtgaagaggtgaaagaaatggggggagggttgcagtaaggtccgtgagtttgtaggtgattcctgggtgcgggaagctgactccaggtgaaatctggagatggttggagagtagctgagagagacagaagagtccctgagggctgggggtgagaacatgagggagactagggagtaagtcagtgaaattcgtgagttcggtggtgtatcgtgggtgcctggaactgactccagctggaatctagagaagttttgacagtagctgaaagagacacaagagtccctgtgggctgagggcaaagacctgagagagaccagggaggacctcagtgaagtctgtgagtctgtaggtgattccggagtgtgagaggctgactcccgctgaaatctgggcgtggtgggagaggagctgggacagacaggagagtcccagggggctgggggtgaagacatgagagagactggggaggaactcagtgaaactgctgagtttgtaggtgactccggggtgcctggaactgactgcagctgaaatgtgggcatggttggagagtagctgggacagacaggagagtccctgagggctggtgaagacatgagagagactggagagtaattgagtgaaattggtgagtttggtggtgattcctgggtgcctggaacggactcccgctgaagtgtgggcgtggttgcagagtagctgggacacacaggagagtccctgagggttggagataaagacgtgctagagactgaagagtaactgagtgaaattggtgagtttggtggtgattccggggtgcctggaactgactctagctgaaatgtgggcgtggttggagagtagctgggacagaagggagggtccctgagggatggtgaagacatgagagagactggggagtaatgcagtgaaattggtgagtttggtggtgatttctgggtgcctgcaacggactcccgctgaagtgtgggcgtgtttggagagtagctgggacagacaggcgactccctgagggttggagataaagacgtgctagagactggggagtaactcagtgaaagtggtgggcttggtggtgatccctgggttcctggaactgacccgcgctgaaatgtgggcgtggttggagagtagctgggacagactggagggtccgtaagggctgggggtgaagacgtgagagagactggcgaggatctcactgaggtctgtgagtttgtaggtgtttctggggtgtggggtagagactcccgccgaaatctgggcgtagttggagaatagctgggacagacaggagagtcatgggtggctgggggtgagctgctggatgatggcagtaagaacatatggtatattattgatgaatgaggtgactgtgaagaatctccagaggaggacacgggagaacacaatgacatgagtgactgtcctgcttggttaggaaagggaaacgtaaagctgtggaattctgttgatgatggatgtgagagtggtgaagccctgcggggtgatgtagagtacttccacatccctggtgaggagctgccccttgggtctgagtttctgggaggggagagggagaagctgggtgaggcaggcatgaatcttgaggagtcagaatatgagtcaccgctcatattctcctgagacctgtgagtctctgggggactcctgggtgcatggggctggctcccgcaggaacctggggatggctggagagtaactgggagccacaggagagtccctgaggcctgggggtgaagagatgaaagacacaggggtggagcaccatgaggctcgtgagtttgtaagtgattcctgggtgtggggggctgactccagctgaaatctggggttgtttggagagtagctgggagacacaggagaccccccgagagctgggggtgagctgctggatgatggcagtaagagcatgtggtatattattgatgaacgtgggggatctgaggaatccgcagaggaggacacgggagagcctaatgtcttcattgattgcccatcaatcaatacttctttaacctgactgaagaactgatctaaaggctttagtacagtgcatgattatgtgagatgctttgagacagagtagtacatttgtgaataaaattttatggctttttttcgcttagtaggaaccattgtgtgtggaaaagtgaggaaattgctttctgctgtagagtctggcattcattgtagatttaagcttatttttctgtgagcaaatcttattcaataaaatactactctttatactaaaaaacaaaaacactggtgatgtgaggtcattatcctcagcaaactaatccagggaaagaaaaccaaacgccacattctcacttataatgggagctgaaaaatgagatcacatggacacaggaaggggaacaacacacactggggcctttcgggaggcagagcgttaagaaaaacagctactgcatgctgggcttaatacctaggtgatgggttgacaggtgcagcaaaccaccatggcacacgtttaccttagtaacaaatctgcacatcctgcacatataccccgaacttagaaacgaaacgaaacaaaagaaaacgaaaaagcaataacaaaacgctaaaggcaaaataaagtttcaaactcagaaagtgacagaccaatgtttggttcaaatcatgggttctcaacccaggtgccataaggtcaggataaaatatttgattatgtattgtaaataagtcatgcagcaaaagaccagagagattattctcaacatatgtgtgtcttctaattcaatggtgacgctatctaccgggacatagcgttagattccaaagggccgagtcccgccagacaggcctcccacactaataacaatgggaagccctacgttgttttacctgtgcttctcagcaactggctataaatcaggttgccaccactcccagatttagttgcattcatttgctagaagagctcacagcacgcaggtaaacacttacatttgccattgtattttagcggacattgcaaaaagttcagaaataaatgtggggcccggcatgtggggaggggcgcactaccttccaggaagtgttatccagaagccctctgaacccagtccttttgggtttttatggagacctccttctataggcatgatgggttaaaccataggctattggtgatcagctccacccgaggctctcaaccctccctggaaattggggttgaggctttgccattctcagtctgactaaaagaatttacccaaacggaattttaaaacagatgagcataactggaatcttaattacatgattggattatctggagccacaccttgatattcctaacccgagcaccctcatccaacgaatgctccacccaactggctcccaagtctctacgtggttccagagcaaaagaatgtttatacaacgcatatctccaccttttcttcaaagtcttttcgtttacacggaaagacttcttaaactgccatgaatcagggtcagggggaggtcttgttacaacacagatctgtgcatctccggggtttgattgtggcaaggatgctgctggtgtcaaaaccacaacgtgggaaccacagaaccactagttggttttcagtgtttcagtgcatacaattcctaatatatctggccaaggaaatttgtaagttattagattgtcccaaaggtggcgcatgaaatcaaagcaggagaacagtttcctaccaggtgtagcctggaaaagttgggggtgactgatggaaaggaggagtgaagctcctccctttccgctgctaggctgcgcccgaggctatttaaacccaccctggctggcctgtactcagatcttcgcggagcggatcagcggccggagcgtttggcggactctgcgtggacttggagctcacagcgtcttgcgacttggaagcggattcagaggacaggacagaacacttgggcaagtgaatctctgtctgtctgtctgtctgtctgtctcattggttggttgatttccattttcttaaggggcacatacctcacaccgcacacacacaaacacacaccgcacacacaaacacacacacacacacacgcgcacacacacactccttccttctgcgagttagaaaattggtacgggcccctgggagctgcaggtttcctaatcatgtctgcacctaagaacagtagggtcttgtctggctcttcttatgaacggtcccccagctgggactccccaaggtccatgcgagcctcacccagcttctccctctcccctctcagaaactcaggcttaaggggaagctcctcaccagggatccggagctaccattcaccatcccctagggcttcaccacactcacctctgtcatcaccagaatcccacaagctcccatttccctgtcctcaccgtgatgggcaatcaatgaagccattgggctctcccgtgtcctcctctgaggattcctcagagtccccacgttcatcaataatataccacatgctcttactgccatcacccagcagctcacccccagctctcggggggtctcctgtgtctcccagctactctccaaacaaccccagatttcagctggagtcagccccccacacccaggaatcacctacaaactcacgagcctcacggtgctccacccctgtgtctttcatctcttcacccccaggcctcagggactctcctgtggctcccagttactcttcagccatccccaggttcctgcgggagccagccccatgcacccaggagtcccccagagactcacaggtctcgggagaatatgagcggtcccccagccctgactcctcaagattcatgcctgcctcacccagcttctccctctcccctcccagaaactcagacccaaggggcagcttctcaccagggatgtggaagtactctacatcaccacgcatggcttcaccactctccttaccattagaacactcagtaatcatatgaattgtgcagttgttgttttgcttaactctttttgtttgtttatgcttggggttttattgttgttgtttcacttttctcccatctcttcctgacttggtcaaatccaaaggaatgttccaaattgtggggagcaaggcctctgaattggctaaaactcctatggctgcaaaaaaacaaacaaataaacaacaacaaaaagcattccagttagcagaaattattttttaaaccttttttgttacgtaactagtctcatctacataaaaaggtcatccttttgctagccaaggccaaactgaaggagtagtggtggtgacccaatgtgaagattctgccctgttcactacaggaacctgagttttgttcctaaatctagttctttctgtttgatatttgtgttacttttaaaacgtcagcagtttgtcccagctatgatgtggtagtaaaagattcaaaaggggtttctttacaggttctatgattaaaagcttaattaaaagcaaatttctttttttaaaaattatactttaagttctggggtacatgtgcagaacatgcaggtttgttacataggtatacacatgccatggcggcttgctgcatccatcaacccatgatctacattagttatttctcctaatgccatccctctcctagccccccacgctgacaggccctggtgtgtgatgttccccttcctgtgtccatgtgttcccattgttcaactccaagttatgagtgagaacatgtggtgtttggctttctgttcttgtgttagtttgctgagaatgatgctttccagcttcattcatgtcccagcaaaggacgtggattcatcctttttatggctacatagtattccatggtgtatatatgccacattttctttatccagtctatcattggtgggcatttgggtttgttccaagtctttggttttgtgaaaagtgccgccataaacagacaggtgcatgtgtctttatattagaatgatttataattttgggggtatttacccagtaatgggattgctggatcaaatgatatttctagttgtagatccttgaggaattgtcacactgtcttccacaatggttgaactaatttatattcccaccaactgtgtaaaagcgttcctatttctccacatcctgtccagcatctgttgttccctgattttttaacgatagccattctaagtgctgtgagattgtatctcattgtggttttgatttccatttctctaatgaccagtgatgatgtgctttgcttcacatgttcgttggctgtataaatgtcttctttggtaagtgtctgttcatatcctttgtccactttttgagggggttgtttgttttttttttcttgtaagtttgttcttcgtagattctgcatattagccctttgtcagatggatagattgcaacaattttctcccattctctgggttgcctgttcactctgataatagtttcttttgcactgcagatactgtttagtttagttagatcccatttgtcaattttggcttttgttgccattgttttttgtgtgctggtgatgaagtctctgcctatggctctgtcctgaatggtattgcctaacacaaggacatttatgtgcctgagtgctataccacccaaagtaatttatagattcattgctatcctcattaagctaccattgactttcttcatagaattagaaaaactactttaaatttcatatggaaccataaaagagcccacatagccaagacaatcctaagcaaaaacaacaaagctagaggcatcacagtacctgacttcaaattattctacaaggctacagtaaccaaaacagcatggggctggtaccaaatcagatctatagaccaatggaacagaacagaggcctcagaaatgacaccacacatctaaaaccatctgatctttgacaaacctgacaaaaacaagcaatgggtaaaggataccctatttaataaatgatcttgggaaaactgcctagccttacgcagaaaactgaaactgggccacacccatacaacttaaacaaaaattaagtaatatggatgaaagagttaaatgcaagacctaaaacaataaaaaatctagaagaaacctaggccaacaacctcaggggaaatgtacctgtagtgaaatgcatggtacaaacacgcattccttgcttccttgagtgggtgacgttgatggctagtccaatcactccaggcacacccttgcaaacgtggctggttcctttttgagccagcttggctttgcccagcatgcacaagtcagtgcaacaactgtgacacaaatggagccatacagagaaaatgagcagcaggctcaggagcagggtgtgcgctgccttgggggctccagtccatgcctcagggctcatatggcactgcgggcttcttgggtgcaaagaggcagaccacaggccatcttcaggaggcctttattttgaagtgcagaaagcagccaggattaccacccgtgggactcggccttttgtgaccctggcctgacagagtttggcccaaggcaggacaagctcactcagagcaacgtgtcagtacctggggcctgtgcatgccagtcaaggccaagctggctcaaagagcaaccagccacctctgcaagggtgtgcctggagcaggtggaccagccaccaacctcacccactgaaggaagccaggatggccaggtttccacagcctgagtggctgcctactgatggctgatggagcagaggcctgaggaaaagcaggtggcatgtttaactctttaatctatcttaagttaatttttgtataaagcagatggcaccagtccatgcctcggggttcatatggcactgtgggccacagaaggctgagtcccctgggtggtaatcctgcctgctttctgcacttgaacataaagtcctcctcaagacggcgtgtggtctacttctcggccccacctttagggtagaagaactgatgtaccacgtctgacagtgagtgaggttggcggctggtccacctgctcctggcacaccttgcagaggtggctgcttgctctttgagccagcttggccttgcctggcatgcacaagcctcactgcaacaagtgtacaacaaatggagccataaagaggaaatgatcagcaggctcaggaatcgggcgtgcactgcctttgtggctccagtccatgcctcagggctcgtatggcactgtaggcttcttggtcgccaagaggcagacaacagacggtcttgaggaggactttatgttcaagtgcagaaagcagccaggattagcacccaggggactcggccttctgtggccctggccagaggtagaatttggcccaacacactacaagctgacttggaaccgcatataggtagctggggcctgtgcatgccaggcaaggccaagctagatcaaagagcaagcagccacctctgcaagggtgtgcctggagcaggtggagaaaccaccaacctcacccactcaaggaagcagggatggccagattcctacagcctgaggggctgcctcctgatggctgatggagcagaggcctaaggaaaagcagatagcactgtggccctatctgtagggtagaagaactgatgtaacccgaccggcagcaagtcaggttggtggctggtccaccagctccaggcacatccttgcagaggtggccggttgctttttgagccagcctggccttcctcagtatgcactagtcagtgcaacaactgtgacacaaatggagccacacagagaaaatgatcagcaggctcaggagcagcgtgtgcgctgccttgggggctccagtccatgcctcagggctcatatggcactgcgggcttcttggttgcaaagaggcagaccacaggccatcttcaggaggcctttatgttgaagtgcagaaagcagccaggattaccacccgtggaacttggccttttgtgaccctggcctgacagaatttggcccaaggcaggacaagttcacttggagcaacgtgtctgtacctggggcctgtacatgccaggcaaggccaagctggctcaaagagcacccagagcatccattctggtggatgagccaaccacatggccagcttctgggtgtgggcacagtgccacatcttccatcactttctgatatatcccaccaccactgaagagacagcctggagagagtgcaagaggaaggctgagaaggatgagatggtgagtgctggcttctttctgaccctcagcacacccgcaggtggtgaccatcaacctttaggggtgggagagcaagattgatggcttcaaatacttccccaagtagatggacacaggccactcagctcaatctcacagccaatgagttgacatgcaagcagatgacagtgacagacttttagaaagagcttcagaaggcggccagtttttcttcggcctcagccaggccttggaacttgactaggccatccacttcaccagagatgccttcaagaacatcagtgagctccttgccaatccgtccaggaaggacctggacccagccatggacctgttagtgctgtctcagggacaccagaccaacatcctggacatcatcctcatacacaaggaagctcttaccaaagtcacgaagaacaggcaacatgtggcagaagagaagacaaaggtacagaggctgatggcatcattatcacaggaacaggatttctttggccactttggctgaaattcaccacttccatccaatccactcaagcgagacttgaaatcacagatggaacatttcttgcaacaagagatacgattttttcaaaaagtcacctaaaatttgatagtgttgaatgactagctattcgattgtggactttttccagttcacgggtactttctacagcagaatgataacagtatcaaagagctggtgccagctatcagtggtagtataaggatgactttgtgctcaactgaaacccagctgaatatagaattgtgtaggaaagtgttaatatggtgatagaatagaaacagtagcaaatgaactaaatcatactatgaatgcctacactaccattataactttttgaagaatgataataccacttactttattgccttttgaagtaggagtaggaatattttagtggatatgctatagaccagaaaccctataaagaatcccaaagaagctggctggataaagcctgctatggatgtctttatactcaaagactgatgaggcaattcgaatatgtgtccccaccaaatctcatgttgagttatgcttcctaatgttggaggtggatcctggtataaggtgactgaatcatgaaggcaaatttctcatgagtggttcagcaccatccccttggtactgtcctcacaatcatgagtgacttctcgtgagatctggccactgaaaactctatatcactccgtactctccgtgatttcctcttgccatgtgagacaattcactctttcattaccttgcacaatgattgaaagatttctgaggccccccagaagcagaagcactaagcttcctgtccattctgcagaaccatgagccaattaaacttctttttcaaaataaatcttaccaaaaatggcaaatgaggactggagcattgctataaagatacctgaaaatgtggaagcaacttcggaactgggtaatgagtagaggttggaagagtttggagggctccaaagaagaccgacagatgagaacatttttggaccatcttagagactggttaaatggctgtgacaagaatgctgacaaaaacatggacagtgaaggccaggctgagggggcctcagataaaaataagaagctttctggaaaatgtctcccttttggatatggaaagcttacacaatgcctgtaccatcattgtaccttagacacagtgaacttgctttttatttcagagactcgtaggcaaaagagaatgtagccttgacccagatgagactttggactttgtaactttgagttaatgctgaaatgagttaagactttgggagactgctggcaaggcatgactgtatcttgcaatgtgagaaggacatgagatttgtggggtcagggacagaataatacggtttttctctatgccccttccaaaactcatgtgaaagtacactccctaatgttagagtcggggcctaggtggaaaaagctttaatcataaaggagtgggagtggatccttcacaaatggcaaagcaccaagcccttaatgccatcctcctgatagtgagtgagttctcatgagatctagtagtttaaaaggctgtggaacctctttcctctctctgtcttgttccaacttctgccatatgaaacatgtcattgccgcttggatttccggtgtggttaggagggacctgatcagtgtgggcctggtcagtggacctaggtcagtgaggactatttagtgggatcgtggtcagcaggggtctgcttagagagggtctcattagtggggtctagtagtggggttttggtgagtggggacctattggctgccagttgtttggtgtctggtcagtgcaaacctgggctgtggggcttgatcagtggagacctggtcagctggggcttagtgctggcctggtcagcatgggctggggcactggtgaccaggtcaaggggtgctattcagtggaggactgggcacatgggacctagtcagcagaccctggtgggcgtgtcctcatcagtgaggtccttgtcagtggggccctggtcagggcagccttgtcagcgggacctaatctgtagcgtcctggtcagagaggacttggtcagtggtgacttttgcagtactagtctacagggtgacctggtcagcggggatctcagcatttggtgccagttcagtggggtctactcactagggtcccagtcaggggcatctggtgatcttaggcctggttattaggggcctgatcagtggcaacctgttccctggaggtctggtcagtggggcctcatctttggggccagggaatgaggtcatgatcagtggaacctgatcagtgaggccttgtcaataatgacatagtcagtgaggacttgtcagtaaggacttggtccgtgaggccttgtcagtgaggccttgtcagtaaggtcctggtcagtggagtccttgtcattgtgtgcctggcagtggggcccttgttagtggggcctggtcatgaggttctaatcagtgagggtttcatcagggaggacctgatgtgcggggtctggtcagcagggacctggtcaatgtgggctgctgagcactgcttggataagccaggtgcaatgtgcattattgaaggccttgtggacagctgggatagcccagtgatgcccaagggcctagtcaaaagtggacaaagcacgtatttggatggacctgggagatcctgctcagagatcctgacaggacaaaggtaaaggaagggccagagtgactggagagatggtcacagtctatgggctgcacaggatggaggaggccagggaaaaggcagggtgggcagttggggttcagggagaggcaggtgcatgctgggaggtcagaccctgtgaaggctttgggggcgtcaggttgggtaggctccagacactctcgctcacataggattccagaacactgctacaaggctctgagtgtttgtccctcacataggattccagaacactgctgccattgtctgaatgtttgtcccccacataggattccagaagcctgctgctggggtctgaatgtttgtcccccatctaggattccagaacactgctgcgagggtctgtatgtctgtccctcacatatgattctagaacattgatgctagggtctgtatgtttgcccttaacatatgatttcaaaacactgctcctggattctgaatgtttgtccttcacataggaatacagaacactgttgctggagtctgaatggctgtcactcacatagaattccagaacactgctgtgaggatctgaaagtttgaccctcacatgggattccagaacactgctgcgagtgtctaaatgtctgtccctcacacaggattcccgaacaatgttacgaggttctgaatgtttgtccctaacataggattccagagcactcctgctgtgctctgaatgcttctccctcacataggattccagaacactgctatgagggtctgaatgcttatccctcatataggattccagaacacttctgctgtggtctgaatgtttgttcctcacataggattccagaatactcctgccatggtctgaatgtttgtccctcacataggattccagaacattcatgctggggtctcaatatttcccttaacataggatttcagaacactgctcttggggtctgaatgtttgtcgctcacataggattacagaacactgctgctggagtctgaatgtttgtcagtcacatagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgtgaaagcctgtagctataaaaaaatgttgagccataaataccatcagaaataacaaagggagctttgaagtattctgagacttgtaggaaggtgaagtaaatatctaatataattgtaacaagtagtgcttggattgtatgtttttgattattttttgttaggctgtgatgggctcaagtaattgaaattcctgatgcaagtaatacagatggattcaggagaggtacttccagggggtcaaggggagaaatacctgttgggggtcaatgccctcctaattctggagtaggggctaggctagaatggtagaatgctcaaaagaatccagcgaagaggaatatttctgagataataaataggactgtcccatattggaggcctttttgaacagttgttgtatggtgaccctgaaatgtactttctcagatacagaacacccttggtcaattgaatacagatcaatcactttaagtaagctaagtccttactaaattgatgagacttaaacccatgaaaacttaacagctaaactccctagtcaactggtttgaatctacttctccagcagctgggggaaaaaaggtgagagaagcaggattgaagctgcttctttgaatttacaattcaacatgaaaatcaccttgggactggtaaaaacaggcgttgacctctgtttttagatgtacagtctaatgccctactcagtcattttacccttttttctcacttcatttatgttggctgacagttgactattctcaaccaaccataaagatatcgagacattatatttattatttggctcatgagcagggatagtcagtacagctttaagccttattcgagctgaactctactagatgatcaaatttatgtcattgttatagcctatgcatttgtcataattttctttatggtaatactataattggaggtcttggcaactgattagtcccccgataattggcgcccccgatatagcatttctctgcataaataatatgagcttctgactcctcccaccctccttccttttattacttgcatccactatagtagaagccggcactggaaccggctgaacagtctctcctcccttagcagtaaacctaacacatgcaggcgcctctgtagatttcactatcttttcactccacttgacaggtgtttcttctacttcaggggctattaactttattaccacaattgttaatataaaacccccagccatgtcccaatatcacacacccctcttcatctgattagtcctaattacagcagttcttctactcctttgtctccgagtcctagccgccggcatcactatattgttaactgactgcaatcttaatactactttttttctatctggctggcggaggtgatcctatcttatttcagcatttattcagattctttggtcaccctgaagtctacatcctcatcccactgggctttgggataatttcccgcgtcgtaacatactattctggaagaaaaaagaaccattcaggtatatgggcctagtgtgagctataggatcagttgggtccttacgatttattgtatgggcccaccgtatatttacggtagggatagatgtggatacatgagcctgcttcacctctgctattataattattgctattcctactagcgtcaaagtttttagctgactagctagctacacttcacggcggtaatatcaaatgatcccccgcaatgctgtgagcccggggatttattttcctttttacagtaggaggcctaaccagcattgtattggccgaggcttatattatggttcattcatatatttagaaacctgaaagtttctaaataagttgtaaaaaagttgtaaaaaaaccccagctgaaataactacgaaggtgcctttaatattctgaagacaaaatagctaagatccaaactgggagtagataccccgctatgcttaactctaaactcgaatagttagatcaacaaaactgttcgccagaacactacaagcaacagcttaaaactcaaaggacttggcggtgctttatatccctctaaaggaggctgttctataatcgataaaccccaatttacctcaccacctcttgcccagcctaaatacctccatcttcagcaaaccctggaaaggccgcagagtaagcacaagtatctacataaaaactttagttcaaggtgtagcccatgaggtggcaagaaataggaacgttttctacatccagaaaaatgtcgcgacaaccgttatgaaatctaagggctcaaggaggatttagcaataaattgagagcagagtgtttaattgaataaggccatgaagcatgcacacaccgcccgtcaccctcctcaaatacattctagaaactcattgtacactcccctgtgatattgtccataatatccagggagggagagaatgatttgatttttttttttgagacagagccttgctctgtcgcccgggttggagtgcagtggcctgatcttggcacactgcaagcaccgcctcccaggttcacaccattctcctgcctcagcctccctagtagctgggactacaggcgcccgccaccacgcccggctaattttttgtatttttagtagagacggggtttcaccatgttagccaggatggtctcgatctcctgacctcgtgatccgcccgcctcggcttcccaaagtgctgggattacaggtgtgagccaccgctcctggccagagagaatgattttactccccatatcgcaggggatttacattcccctgcattatttttcgtaatatccagggggaagatgaagatgttactccccatatagcatgggagaacaattccctgcgatattgttcataatatctctgggggaaagaattatatttctccttttatcgcaggaagtgtacacccccttgtgatattgtttataatatctagtgggggagaggatgatgctactccccatattgcagggggtgtacaaccccctagaatattgttcataatatccacgcggggaggagatgatgttactacccatatcgccagggtgtactgccccctgccatattgtttgtaatatccaggctgggaaaggatgatattactccctgtatcacaggggatgtacacacccctgtgatattattagtaatatccatgggggagataatactacttccaataccataaacaccctgtgtgtacaccctctgtgatattgtttgtaatatccagggtgggagaggagtatattactccctataaggcagagtgtgtatacacccctctgtgatattgttcataatatccactgggggatatgatattactcccaatatcgtaaacacctcacatgtacaccgtctgtgatattatttgtaatatccagtgggggagaagatgattttactttccacattgcaggggtttacacccctctgtgatacagtttgtaatatctagagggggagagggttatattactcctcatatctcaggacatgtacaccccctgtgatattgtttgtaatattgttcccaatatccttttcccccatggatataggaacagtatcccataggacgtgtacaccccctgccatattggaagtagtagtgttttctcccttgctggacattaggaacaataccatgggggggtgcacaccccctgtgatattgacagtaatgtaatccactatcccctaaatataggaacaatatcacaatggtgatgtacacacttggtgatattgaaagtgatatgatcctctccccacctgaatattgggaacaatatcacagaaggggtgtacaccccctgcgatattgacagtaatatcctctcccacccccggatattaggagcaatgtcacagaagggttgtacactccctgcgatattgacagtaatatcctctcctccccggatattaggaacaatatcacagaagaggtgtacacccactgtgatattgacagtaatttcctcttcccccccggatattaggaacaataccacggggggtgtacaccccctgcgatattgacagtaatatcatcctctccccgccagatattagtaacaatatcactgaaggggtctacaccccctgtgatagtgacagtaatatcctctaccccccagatattaggaacaataccatgggaggatgtacaccccctgtgacattgacagtaatataaacctctccccccaccctggatattaggaagaataccacggggggtgcacaccccctctgatattgggagtaatatcacccactatcccctaaatattaggaacaatatcacagggcggggagtacaccctctgcaatattgggagtaatgtcatttccctgcccctgcatactaggaataatatcacaagggatgtacacccccatatgctcttgggagtaacatcactctttcttcccatggatattaggaacaatatcacagaaatggtgtacatacgctgcactgtatagaataaagcaggcggaggaagatgggataaccttgctagctgaagcttctggctctctttttttcttcttcccgtgcaggacacttgcttcccttcttcctgccctcggacatgagactccaggttcttatgcctttggactctgggacttgcaccagcggcttccccgaggctctcaggccctcggcctcatactgaagactgcactgcgggctttcctggttttgaggcttttggacttggactgagccactactagcttctctctttccctacctggcagacagcctattgtgggactgccttctaaccgtgtgaaccaattctctctcgtaaactcccttatacatatacctgtatcttgttggttctgtccctctggagaaccctgactcatacattttgtttattttttctccattgtcctttcctctgcttctaggcttacctagaccaccaccattctttccccctttctaaagtaaaagttgtctttttctcactaaatgcatggcattctgcccgttttccatggctttcctcagccctgctctgtttattcttgctatcttaagaggaaatccctgcctcttccgtggcttttcccacttggtctacatactggtttctgttgttctcagagacacactgggacctttcacatctcactgtcacttcttggaagggctctctacctcgtctgcctgctgagcaacctcttggggagacacgggccctcttgagtcactgaacttgagctatttggtgttggtatgttaatttatcttcttagaccacttaccacttctttaacttcaaaagagaagaataagtattattttccatggttgatatgaagagtagaaataacttatacaaaatgcattgcagttaagtgataataaatggccgtgaatgcccttattaatgttattctatcagtctcggctcagataccatctgctctgtaagctctgctctgaatcatatctgcttcttctctgggttccttgtgctctgttcttaactactttaaagcagtaattgttctgattctaattagtgatccttcccaataaaattttaaatttgtagatctcttccccccacccctgccccagcctaaccagtgttttcttacttttttgtgtacaggctacatcactggtctttcatttgtggctaaataaatgttgtgttagaagagtaaagagttcccagttacatgggatctatagttctacaaaatgaatgtatacataatccatgtaaatattccacttattttaaaacaattttttaatttttaaattaaatttaatttgtgcatgtgtgtgagaccagagatggcggcggtgaggggcggtggtctcaccatgttgcccaggctggtcttgaactccccttgaagtgcccccctcctcacctggcccccctcaccttgcctcctccccctcactcctatgccagtccctgccattccctaccccctctgctgaccgcaagactcaacaagtgacttgctgagcaaaccctgctgagaagaggtctgtttagggacacaggaggccaagtacacaaaaaagcaaaagaactagcatgactttttcaatggatgtctattttacagggctggcttcagattattgttatagctttaaataaaaggaccgttttgtcatctcggcccatggcctacattatttctttactgtccattgccctgggcgcttgactaataatttaacagcaatttttttttaaaattttaaatcatgattcatcgcattgctgtaagagtaattagaggtaaattagggcttgaaactgcctgtagtgggttactttctgagatcttagcataattatcaggtgagagggtgaagttttaattagcgctaagtgggatagaaattcaatgcactgaaactgcagtgtccaattcagtaggcgctagccacctgtaactattgagcacttgaaatcctggctagtcctaattgagatgtgttgtgttaaatatactggattttgtcattggagtgggaagaacagcgtagaatatctgcttgataattttttatattgattacatgttaaaattattactatgattactatttgggacatactgagttaagtatatttaaaattaatttcaccttttaatggggcttactagtacatttaaaattacatatgtggctcacatatttattggacagcacggctctagaagtttaggaagaaataagaaaaatattgagaataggtagcaacagtaggaagtttgacctcctgtaagactgattccaataaaactaataggtgatagttttaattggctttttcctactagaaaaagtaagtgtactttacatgtctctttgttctccctctttccccttcaatttagtggttagcgtgtatttactatatcaggcttaatattcactaagcagtgttaagaagacttaggtaaatgattccctgatgaacacacttgattttcaaagcactttcctaacccatttttaattggaatagagtcaaaggtagatggcttattattagtcatctcatttaaacctcatggaattttcctgctaaatctcaaagtaaacaatttgttataggctgttttgtcaagtgcatggaagggacagcataagacatgtggtacttcatttcaaaattgcttgagatggttttcattataatcatacattatttgcttctggttttccagaaaagccagctaaacctgtggttcatttagatataaatgaaatatcctcaaaggattgctcaaagtgacttatgcaacttgaatatatatttttttctgtagggtgtttattccaaattatctggccatttgtggcaatttgcagttttttagaaaacaccaaatatttttcaagttagagatgttttaataaaaacagtcatattgaactggaagcagccaaataaaatggtcctttatttcacagttgagaatttgaaattggaaggtaattaacatatgtaaggatgatgtatttgctgcctggcttataggaatgagccaaggtgttttttgagggatgttgttgctgtgtatgtcccacctattttgcttccttaatgaacaatgcaagtttgagacagaaatatttgagaacatttttatcagttgcgacattttgatagtgaacattttatatcttctgtaaacttaaaatgtttgcatcttctgtctgcttaaaatgtttaatttgttatacccaaataatttggctataattgataatttaatttatcaaattaaattgttttttttccctttagactttcttcagtcacatctgaataaatcacttagaagtaagctagatgtaatataatgaaatgcttaaaagggctgtgtatcttcatattacacttacagtgactttctgctgtacccattatattctacctgcagctagttgaggtaaagagagggcatttaactgtcaaggggacctgttaggagactgtagaaatctggaaagtctcttgggtctttgagggattttgggatgcagagagtggggctgggatctctggctaggttggagccagcctgcatttgtatctttatcttggaagcaaacttagaatgcagagatagatgtggcctggatgctgctaactctagccaaccactaaatcttaaggtgggagagatgcaggctttggctgggtgctaagctgctgtagctggttgaatgtagaggtcactatcttttctgaatacttgtaagtaaattaaatcattctctactcctgtatgcctgccaaccaaatgggaaatcgctatagaaaagatggcttaaattttagtctttgaagtggttaatgcacgtttctggaatcaagatttaatgtggacttggattggatattgaatatttttgatttgtctacttttctctccatagggagcttatagcttcattgcactgtgtgtgacatttgggtcctgtttggcagcaatgactgcctttctgtttagtgtctgtgtgctatgaagattgcacacaggggtccagatgcatcctgttttgagaatgttaatggatacaccagctgctgctttggatttcacccattggcggtttctataaaaactttagacacagtgagccactcttctcacggaatggtggaaaccctcccaattccaatttcctaaacaccagccaagggccagccttgcatgcaggcctttctaaggatggcagtctcttgcctgttatatgaaatcttttctgcacactttgtataaccccaacttaatttttggtgttgttttaaaatttcattttaataacataatattataagataaggtaacttggtactaatttctgttgtatgatccatcttaagttgcagcgctggttacttttttgactttcagtgacgaacagctatttgtacataagttaccatagcaatttaggtaattataatctgtcctatttatctcatttacctttcagtaaaattgttaaataagcaaaataatttctgagttaaaattagaataaaaattgtcttttatttggattacatgaataatctagttttcatattgtgctaaagccctgcttagaattatgaaataagataaaatattcaatcatttttatcaatattttcttacctaagcatgcaattaaatttatttattttatatacttcaatttgagaaataatgaccacatgttgttactttggtcttcaatgatctctaatttttagggtcgccatgtcttgcttaaatatatcatagtaacaggttcagtgaatatctttatttttaattttatttacttatttttttttgagacagagttttgctcttgttgaccaggctgcagtgcaatgacacaatcttggatcattgcaacctccacctcccaggttcaaatgattctcctgcctcagcctcccaggtacctggaactacaggcatgcaccatcatgcccggctaattttttatattcagtagagatgaggttttaccatgttagtcagactggtctcgaactcctgacctcaggtgatccacccacctcagcctctcaaagtgctgggattacagacttgagccactgcccccagccatcttttttatttatttattttaattgttgttctggaaatcctgggatgcatagacagtgaatatcttttttgttttttgagacagaatctcactctgtctcccaggctgcagtgcagtggtgctatcttggttaactgcaacctctgctttctaggctcaagcgattctcctgcctcagcctcccgggtagctgaaattacaggtgccagctaccatgcccagctaatttttgtatttttattagagatgaggttttgccatgttggccaggctggtcttgaactcctgacctcaggtgatccacccacctttgcctcccaaagtgctgagattacaggcatgagccactgagcccagctgaatattttttttaaatcaataaccttatttcttagagtagttttaggttcacagcaaaattgagaggaaggtacagagatttctcatatatcccatgcctcccacacacgcatagcctcccccattattagtattttccaccagagagtggtccatttgttacaactgatgaacttacattgacacattataatcacttgaagttcatagtttacatcaggcctcactcttgatgctgtacattctgtgaatttggacaaatatataatgacatgacatgtatctattactgtaatattatcgacagaacagtttcactgccctaaaaattctctgtgctatgcctgttcatctctccctttctccctagcaactcgtgacaaccattgatgtttactctgtcttcatagttttacttttttcagaagagtcatatagttggaataagaagagtggatatctttttgagtagttaaaaaattaaagctccatggcagttgaatgtagtcatttaagatgttctttgtccttttgtttttcttttgcttctttatcattgtaaagaatgatgtattctgatgagatatgatttacatacttagaaaacatgatttgtatagatatgtggcacataatagaaagggttgaggaaaaggacaccacgccgtactacacagcacaacctggagcatcttgctctgtgaggtgggtccagatagactctttagcaatggaagaggacaagtgcaaagtgttgtgctttataaaactggaatcacaaagtctttcatacttacattcggttggaaataagaccaggcatgaatgctattaggtaaatacataagttcctcactgatcctcttcctttgagggatgaggttgacaacagcctgtattatgatggcatgactcacctacaactagattctgtcatgagagatgacaagggagttttgctttatgcgaggtgaaaaaaattttttctcctactagggagatgggcaaacattagaacattctggtagtaaaagggcattgatagtttcctttctatatattttttcacatcagataatattgcccggcagcctgccatacctccccagtgtttattcagcttctctctgaatgtggataagctcttaaaggagtgatctttccagtggttctttctgtgggaggtaaaatggcaggtgaatttggggcttgttatacgtaggccagagcaaatagctacaactaaggaaaccacccagcaccttacccagaagagtattagccagagtaacacactgatctctcttgagatcttctccactggtggctggaaagtatttgcaaggattcctgtttctggtctgattcctatgttttgttggtttctggcgatagcatgttttattctaaactaaacagtttgatctgaagagctagagaggctgtgtggtgttataacaaaataagtgcagtaactacaccttaactgtgggagatacatttcaagacccccagtgcatgcatgaaaccatgaatattactgaatcacaagctgtttttccctatacatacatatctatgacaaagtttaatttataaattaaattaaatctgatgttatctgtagatagggtgtgagaattgaattgtgtcatcagcaggaatgattgcttgtttgttggtggggaaaaactctccacacatttggttacagaagccttctttgttgatgattgttgctgtggtgtgacagcagagaaaaacgtgtcaagtatgtctttctgcgcatatagtggataaggggtactagtgtatactctgttgtaatggcccctcatattttggtccagaaatcatgctctttgacactgttgactcatcacacctgttctgctaacaataccatttttactcaatctcataggctttggctaggatgacttgtatacttcagttcacttgtagataccaaattttaataaatttattcttctttgcatctaataaatacagagggaagagttcttactgcattaattacctaccaatacttataatgaatgttaattctaataagttcccaggcatgctcccaaaggaatgctttgtaacaaaacgtcagtcttatgctttaaaaaaccaaaccaaaccaaaacaacaacaacaacaaaaaacaggatctaaagcatacacacaagtgtgcacaatttttttatgaaggtagagtcttactatgtttcccaagctggtctcaaacttctgggctcctcaagtgatcctcctgcctcatcctcccaagtagtttggattagaggcatgcatcactgtgcattcttatgattttaatattctgtacatttattattgatttaaaatgcattttacctttttctttaatagatgttggaatttctgatgaatctgcagtcaggtaagatttcatagatttaaaaaattatgttaactaagaaaatatagatggaagaaactaatatctgttgagtgttgtattctgggctagacatcctaatatgttctatgcatttatcatctcataaagccatcataacatctgtgttcctataacctactgttaaataaacaactatggattagagctgattaattgcctcatgatcccatagttaacaaagtagctggcctacagtttgaccatcagcctgcctgccttccaaatcctttctcttgctcctcagcatagattgatagatatctgtgcagcccttggatcaaagtataggtctgaatcagatcaatcagattcattaatttgattaacttctaaattaatgagagtttaaataccttgaactctcatttaagtttattgttagaatgtggttagtcctaataaatttgacgatttcagtggtaaccagtatcttatttttaccttcaaaggctctagggcagatctgacttagctttggccataggactgtaagttttaccaaagcaagtttaggcaagtcttagagacaaattatttgacttcacagtttggttttccatttaggcaagtatttctgcttacttccataatacattttttagtcttgttgctttttccatgacttttatataatcttgtcctcattttttaaaactttcttctctgtttttcttggtgtttcttttgttctattattttttcaaactctgctgcctatgtattccaagtttttctatagacagaatcaagaggacatagaattacagaattttaaggaatcttggaatgaattaaaataccttctagtatttttctctgcgttgaacattctggtcaagtgattctctagatagagaatgtgaggctcaaagagattacgaagcttttttttagacataggaattggcagaaatgagatttgaactcatggtaaagcccagtactcttgcttctttctatgtcctattggcgtgtgttttaataatacaaacggaagtgagtctgtggatagaatgagaatggaattagctggtgaacccaatggaagtagataagaatggaatgagcaggggaagtccaagtttgaagataaacaacactggattggataggagtacggactcttctacaagagatcaaagtattggggtttatgacaagtttgataaagataaattataaaaatgaaggacacaagatgttgggaattatctacaaaggcacattaaaatagaaggttcaagggagctctaaaaattttgctgctttttttttttttaaatcaaggactgacaaacttgaagatttttactgaaagatgccaaaacattttgagacactgggaagaatgtctacagcagatagaaatgtggtgtcatctacttccatcctgacttacaaaggggtggcttagagcccctggagtactaaggggatggaaattgctgaactacatagatgtgtggcacagggcaggtgtctcctcacctctgcctcttttcacagttcactgatgtccttcccatgtccatgtgggctgggtcaggggcatgattagctggaaaatcagtcatggagttcagttgggtagttggtagtgtgtatagctggtggcaggtgatggagactccagttagcttgtttttcaggagcagggatatagagagctcctactcctggtcatttgaggccattctttcaggaatctgtgctttcatacactgaagatttaaagattggagacttctgtggaaccctgcagaagtagaatctggaagtgggtgtccataggaagaaatatacttagatagtacttagggaaatagaggtacaactatcatgactctgtttcttttctggcagtctctctccttgggtgtctgagtgcctatgaaaatttttaagggattgctagtttatgtggacctgaataaggtaggacctatagagtgaaaataataggattttataattgtgaatattttaatctttctgggaaaagtattctcaataagaacatacatctttgctatttgacttctgtacatttagctttcatacatttcaaatattgtgttggttttcctgtaccaatttagggtaaaggaaagcaataggaccttcctaagttggatccatgctgaggaatcaagactaccattttgaagtgatgtagattagtcttttatccagagacagatcatggaaaagagacagtggatctttctaccttgttttaggtcatcagttttattccagtttagggaacaaaatttatgtcatccattaattgaattttaagttcagcttcaggacagataatttgtgagggcacattattgtcaggctctgccaatatattgactgtcactatttgttataaacctcaaggttagttttcattgaatattttatagatttagacaggtggaggcagaaataggtaactaaaatctctttttagaacagaggacatattttaattatatcaagaatcgtaatttaatatatagatcactgacttttccccagattatgttttcctttttttgagggggaagctggatataaactggcagttaaaaaaattgtaaagaaatcaacttgctcattttcattgtgtatttttgctctcaagcattttgcatgaactgtgtgtggattcattgcctacattggatgatgaagacttgagtgttgctactaaggtaaagtggtctcttgtaaaattaatcttctcactctgggtgtagttttgcatagtatttacttttcaaatttagcagtggtttacctatcattgttttatggtggtaatggaaagctggtcagagaaaaacatacacatggctagttgattcaaaaaatgtgtttaactttggtaactaataaagattggtaagtactgtgacagggtgggagctgaaaaataaatgaactggaaaataagtagtcacaggaaaatcacattaggaaatgctttctccaatagaggaaatatgaactttggttaaagtttatttggataaatactaatactttgacttttaaatcatacgagtgtgactttcttaatatttattcctgtataaaccttcagtggatcaaattgtttgcagtaatcatggaatcctcctggtaatttttagtggcagaaatgttcagcacatagcatatagcttttgttcttggaaacttatcattttggtgtcatatagtttttaggagagattgtttctctacttatattattggttctgtagtgagactaaaaaagtattaaaagttgtagaaaaatagctgagtttggtggtgtacacctgtagtccctgctacttgggagtttgagacagtaagattgcttgaacacaggagtttgagaacagcctgggtaacattgtatctgatttaaaaatataaattgtggaaatgtagaaatttaaatttatgttctcaagatttgtattgcaaagggatttttatgtgatttatgagttgtccatgaagagtttatataaaacacttcatctaattgaataacatgtattttcctgcaaataaccagttctagaagcagagactcttaataccaatatggtaagtctttatcatcataattttgtcattgtagtttatttaaaatatttacttggccaggcgtggtggctcacacctgtaatcccagcacttttggaggccgaggtgggtagctcacctgaggtcaggagttcaagatcagcctggccaacatggtgaaaccctgtctcttaaaaaaaaaaaaaaaaagcacaaaaattatccaagcatgatagtgcatgcctgtaatcccagttgctcaggaggctaaggcaggagaatcgcttgaacccaggaggcaaagattgcagtgagccaagatcgcaccattgcactgtaggctgggtgacagagcaagactacatcttaaaaaataaaataaaataaaataaccactcaaagtccttatatcatattctgaaagtttgaatgtcagaaggttttctatttagttttttaaatgatcattggaactcctgcataccataagctactggaggtcagtaaacatatttgtgtgtatcctggagtacctagaatacagtcttccatgtaagaagcattttacttgttgttttttgagatggggtttcactctgtcacccaggctggagggcactggtgagatcttggctcactccgatctccatttcctaggctcaggtgatcctcacacctcagccatccaagtagttgaaacaatagagctatgtcaccatagacctgtgtcaccatgctgggctgagttttgtagagatagggttttgccttgttgcccaggctcttctttaattgttgggctcaaatgttctgctcgcctcagcctctcaaagtgctggggttacagacatgagacattcagccttaatagttgtttaatctgaataaataaacaaatgaatttttatataatggaatgttataagtaatataataaacctaatgtatccaatcattaaatattgtatttaaaatattgcttacattgtattattttttaatatttaacggtgtataagttttgacatgttatgttgagaatttatgccataattaaaaaggaaataaaatagaaataggtcatcggtagcaaagagggttacaatatattttctagtatcattcaactggaatcttaacattgagattttagattaatatttcttaagctttttattagacccaactcatgttccattaaatacaccatttcaagccatacattactctttattattattattatactttaagttctagggtacatgtgcacaacgtgcaggtttgttaaatatgtatacatgtgccatgttggtgtgctgcacccattaactcgtcatttatactaggtatatctcttaatgctattcctcccctctccccccaccccatgacaggccatggtgtgtgatgttccccatcctgtgtccaagtgttctcatttttcagttcccacctatgagtgagaacatgtggtgtttggttttctgtccttggaacagtttgctcagaatgatggtttccagcttcatccatgtccctacaaaggacatgaactcatcattttttatgctgcatagtattccatggtgtgtaagtgccacattttcttaatccagtctatcattgatgggcatatgggttggttccaagtctttgctattatgaatagtgctgcaataaacatacatgtgcatgtgtctttatagcagcatgatttataatcctttgcatatatatccagtaatgggatggctggatcaaacagtatttctaattcttgatccttgaggaatctccacactgtcttccacaatggttgaactagtttacagtcccaccaacagtgtaaaagtgttcctatttctccacatcctctccagcacctgttgtttcctgactttttaatgattgccattctaactggtgtgaaatgatatctcatagtggtttcgatttgcatttctctgatggccagtgatgatgagcattttttcatgtgtctgccatacattactctttagaattctggtgaccaattctttttctgggtggaaagttgatggaaagttccagttttctctctctgttataataatgttctttcaggtaatggtagatgaccatatttagctaattgaatgtcttatagtaagaaacactatcacagaagtacttacaaaaaactaattgcagcataaatattaattagtattatcagagttatgaaagaccgaaggctctgttatagatctatttccccatgtactttattgtacttcatgtttttcgttttctttcttggcttaagctcatatttcattgactaattaggcttgttttttgtttgtatctctcttttaaattgaaatttttggggaggcagggtcttgctctgttgtccatgctgtagtgtagtggcatgatcttggctcactgctgtatccacttctcaggctcaagtgatcctcccacatcagcttcccaagcagctgggactacaggcacacaccttcatgcctgactccttttggtattttttgtgtagagatgtgttctcattatgttggccaggctggtctccaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacattttgggaggcagaagtggaagatttgcttgagcccaggagcttgagaccagcctgggaggtataatgaggccttgtctctacaaagataacaataaaaacattagcatgacatgatggtatgcacctgtagttccagctattcaggaagttgaggtgggaagattgcttgaggtcaggagtttgagaccacagtgagccataatcaggcccctgcattctagccctgggttgacagagtgagacccagtttcataaaaagagattgataagaaactcttgatgcaactcattataattttaaatggaaactaattcttgatattaccttagcagtgtgtccccaagaaagtgtcagagcctttacgtggaccttctcatgaaaaaggaaacagaatagtcaatggaaaaggaaaaggtgagaaccgtattttatttaaaaagtcatttgatggagaccaggcgcggtggctcacgcctgtaattccagcactttgggagccctaggtgggcgggtaatgaggtcaggagatcaagaccatcctggctaacatggtgaaaccccatctctactaaaaacacgaaaaattagccgggcatggtggcaggtgcctgtagtctcagcaactcaggaggctgaggcaggaggatggtgtgaacctgggaggtggagcttgcagtgagcggagatcgtgccactgcactccagcctgggtgacagagtgagactccatctcaaaaaaaaaaaaggcattgatggaatgtttcttttaaaatatgagcactaatagagtttaatagctaaagaaaatgtcctattaactgtatcataagtaaaagagaaatgaaatggtgataagtggtgtctctaaccaagggtcagcagttgattctattggaagtaccactaaaggaggtgagttatgagttccattttaacatactctaagacctgaggcaagtcaggagagagggaagaggaaatgaataaaagagaaagaaagaatgaggagggcagagtgtacatggaataaataaaaaaaagtggatgtatgtaatggagggtagtaaagtcaaattgatctgtagaagaaggaagaacagggtgttagaaataggaaggaagataaagtgagcttccagtaccaaaatgtgtcatataattacagtaacattttccttctcttgctgtcattctcgctactggggaggcattaaggattgaggtactttaccatgcagacctgtgttttatctaccatagatgaacatcaccataaatggtcagccatgtatgactgtaatttgttttcatagaaaatgttgtaacttcataggatagtatcatattaacataattgaaaagaatagtgttgggtgatttattgggaagaaattaattagagaagctttgcctgattaaaagttcattagaaacattatggcttataacgtagtattaaattcagggacataataggaaagaagttgaggctaggccaaaaaggccaattagggtaaaccaatatggaagcacaccagtgtagaacaaggcattcaaattgtcatgaatacgttgaggagcttctggaaagtgcacattctgactcagcaggtattggagtctgcatttctcatgagcactcaggtgatgtttgtgctggtccttggacacagctctgaatagcaagggaatagccttcctttagagaaatctggaaaaagaaccactggagagcaatttaaaagataacagaatccagggaaagctttaatttccttttatttctgagcatgattctagccacaggggaaggaaaatgagatgaaaaaagagagattacaggtgtatactactgctgaatacagatgaaaaaagtggtcacaatcatccataaaaagcagttaggaagggaagcatcaggatgacagttctgataatcattttttcaaaggaagagggatggtgaaaggacacaaaaggaggaaagaaagacatttgctggggtcttgggagttaaagccaagttaacttgagacaactcacttccagttgcttcagcatatgcccagtctcacaaaagaggttattgctgtggagagtactggagacaggagggagtgctagagttggggtaaaccacagcagctcatttcacttgataactgtcaggcctcagggagagaagtttcactgacatgagtgaataagatatgattaagttgcatatagatgctttggtgaaatttttttgagacagccagttcttcgatatgatagctgttttataaaagtcctttacagtgtaagataatataccaaactcagttaattttagaagtaatcataaaattcattccatgaaaaccaaaattatcattttcaataaatactgcactgattttgaaatataaatatgtattaatatccagcaagtctgtggtcattcaatgttttcttttttgataaatattttcatatcagaagcttattcgacatggtttatttgatgtgttttatggaccaccttgcatgagtggatcaaggagctctaattcaaggccaaatgaggggataggagaaatgtaggtgctgcagtagcccatgtgatcatgggaaaaatgagtagtttgattagctgttatttcataagtgtgtatcctagctgatcaatgtagaaccctttctttgatgagaggtgaatcacacattcacctgaactgtcatcccaactgcgtatttcctcagtgacaagacaaggggaatttatttgtgctgtgctggcagcaatgcctctggtgtgtggagttaaaatactctgtacattcaccatcagctttgacattgattctctcaggtttgatttgcccctctgtttaatggtcccttttctcctcatcagtccacatgttcacggttatatcaatgcttttctattttaagtataggcatttgaaacataatctcactactgaaatataaactgtgcattttgggaatcctatattcctattttcctcattgtgtttctgtcatgttgctgtcctaggcaatgaaaagaagaagccaagaagaaccctcaaaaccttaagtaattatttttatagccaggcctgagaattcagctcgacagtaacactgcatgaatgtttggttggccttgtcatacttacatataattgatgacatatcccctttgctttgtagggcctcctgcaaaacatccttccttgaaggtaattaattatgtatatttttgaatcactaactccatgttgtataaaatatatatgatttatgaatcgttatcttttaaaacccattcagcctagcactgaagtggaagatcctgctgtgaaaggagcagtacaaagaaagtatgtacagacattgagagcaggtacatttaatggaatactggaaataaagtacattcaatgattggatgtactcatattattcttattcctaattctatttgttcaatattgaacagaaggcattgacataaatgttattgttggtatccatatttgaataaaaacaaatttagaagcataaaaaagattttaaaaatgtaagctttaagtcagatgtttctgtttaaatgttttgaatagcatgaagttttcagtataaaatttttatacttgtcagggattcaaagcagtgaattttgagactcttaagatatttccagtgagttaagtgctagttggagttctgatctttacctagaggaaagctttacttattaaagtgtcagtttctgttttaacttcagaggcttgctgctagtgttattacactgatgatctgaaacctatcagatgttctaatgagcaagactgtgtgtgtaggtgtatatatagatgtgtgtatgcgtgcgcttgtggcatctttgactattacaaatgacgaaagtaatgattcatttatgactggtagacacagtcttttaaaatggtgattttgagcctttttggtgttaaagtttttaaaacatgattgcatagaggctaccaacatcataagttggttgtttttcatttcaatgcccttttgaaatctttaattacattgtgatgctcagaaataatatgcagaattttttgtgtcctaaaatggtatgtgagtggttatacactttatatacctttctgccactttctttggtgtgttttgtattatattttccacttgtacccacattggtgtgattatccctggtttaattcattttacactgttcattgtattccctcataccactttaccacatttagttagactctcctgttgctgataaatgaagaaataaaaagaaaaataatgtcagattaagagggcttttctttaattggtttgtatctattagcgtttactatatgagagtttaaacctgaaaagttcagaatacaagcatacaccaccatattttattaatacccttagaactatgactcatgagcctttagcctatgaagttagcacaattcatttctctgaagaagaatgctgggctgttctcagaaaagaaaactgaaaatagcaaatgatattgtcttattttacctcttggacatccttgaatgaaactgctactaaagggatactcggatcaaaattcagatctaatgttttgaacagtatagtttgtgaatgtccagtgatcatgagcccttgatggggaaatgacccttcgagtttcacttttgcattctcttttcgttgacttgtcttgaaagcttaaattcaactattttatttttacagaaaccaggaatataacttttaaaatatatgtctgtcctgtctcacggtgttgtgtactcttcagatcttgtatgaacatagacttatatgggaaaaattaggttgtttgtttatttgtgtttttgagacagagtcttgctctgtcaccaaggctggagtgcagtggctcagtcttggctcattaccacctctgcctctcgggttcaagcaattctcctgcctcagcccctcgagtagctgatactacatgcacgtgctaccataccctgctaatttttctatttttagtagagatggggtttcaccaggttggccaggctgctcttgaactcctgacctcaggtgatctgcccacctcggcttgccaatgtgctgggattacaggtgggagtcattgtgccagctacaaataagatttttaaggctattatactttatacaattatttggtctatgtgaattctgaaggtattcatgcattgagggaagattatctcagtttaatgaaagcattttttaatttaacgtatattcattaaaattttttttgaagtttttgtctctagtacacagaaacacacaataatgtcatgggtatttgaccttaatgtgtttatgcacaaacttagttattgaaatattttcttatacctgaagaatcttaattactaataaacaaatttctcatggaaaacaacatatataacagagatggttgagtgattgaaagtaaactgtagtaaataccagaagcttagaacaagttaagtaaacttttctgagttaatagcaattacaagacttttaaaatacattagaccacgggggagtagtgcatttgtggggtagaggacaacatggtactgcttcagtgaagaaagaacttttacaccttattacaatttgtattattatttacattctaataaataaaaactttattttcagatattttacatcatgtttctactagttgaaccatcaatagtaagacttttcaaagatttgggaagttgtgagttgatgataaatatctgtatcaccatcagtgataaaaatcagacagcaactaccacagattttggacacgcgaacttcatagttaaagaaaggattaatcttggagctgtgtttctatcaaggaattacactcttctttacctgtgtgaatcgcagttattagagtagaaagagagcaaagaagggaaagaagcatagaaaattttattctagattacctcgtttggcttcatgctaccatagttctgacttttaaaaagtcattttgtggtcaaatgtactttgtgtttactccccttatgcagcctacaaccaaacagaatggttcttagcaaggcatttgtattcttcccttaaggaaagcaacatataaataacaaagagaatgagaagaaagagtgatttcattgaggttggtatttaacataaatttgagtgcaggtaccatgattatatttagaattttgtggctggatgggaaaaccagctagatgtctatagatttcctactcaaacacaatgtgcctttgttttacttttacgtctctaatttagcaattattaggtacaactgtatgcagtgtcactaaaaatacctcccaaaaccaaatattaaataatgtctatggctttctgttttatagtgtttatttttgcaatattaatgggaaccacttagcatttgccttgtggtgtctcctcagctgtattcacatattccatcaccttttcttaatggataatcatgcactatgagtaagggttttcagaaaagctgtgtcttttaaagataacacaggagcatcaaatttaattctgctaggacgcctggtctactgattaactgcagctaatatgaggtctacttcacatccaagttaaattcagtgcccttaatcagtcatatgatgaggtcaacagtaataaattatgcaatattttttcacccacccctatagttttaatttctttttccccttgtgtctgtgtttaacattttgctttgcaaaacatgatgataatcttctaaagtagtgaggacaagctataaatccaaagtttcttacctatgcaaatgacttgtttgctctattttctcatgagcttggtagatccaggaaacataacttttaaaacaaaatccccatatattgctgggtgtggtggctagtgcctgtaatccagcactttgggagtctgaggcgggcagataacctgaggttgggagtttgagaccagcctgaccaacatggagaaacccatctctactaaaaacacaaaattagctgttcatggtggcacatgcctgtaattccagctactagggaggctgaggcaggagaatcacttgaacccaggaggcagaggttgccatgagctaagatcacaccactgcacttcagactgggcaggaagagtgaaattccatctcaaaaaacaaaaacaaccacaaccacaacaaccaccacaaaacccaaatgcatttccttggcacagtaaaactgaaaagaaaaagggtaaagtaaatacaagtaactgaaagagtttatgtatattattttacttctcatttgataaaatttgtaaagtaatgagcagagtgtatttcttcagggacccagatatatacatttatttattcaatagaaattcattcttataatggccactgatacctatatcctaaatatttctgaaaacatctcctcaggcctgcatcacctttgcaacattgccttatattttatctttgttcattgatttatatgcctcataattttatgctcctcacagtatttagagtgaattatccttaatgcaaatagatccgtgaaccactcctgaatacctaatgtccaagcatcttaaaggtttatataaggatttcagaaactgacttctgggttgggcaaggtggctcatgtctgtgatcccagcactttgggaggctgaagcaagtggatcatttgaggtcaggagttcaagaccagcctggccaacaaggtgaaaccccatctctaataaaatacaaaaattagcaggtggtagtggcacgcgcctgtaatctcagctactcaggaggctgatgcaggagaattacttgaacctgggaggccgggttgcagtgagctgagatcatgccactgccctccagtctgggagacagagtataaccttgtcccaaaaaagaaaaggaaaggaaactgatttctgcccaaatctccatctgtatccctttccccatctgcctttttctctggaattactgagctgctggtaatggcccctcaccattcctcttctgcagagaaatacatactctcttggaggcttctcttcctctcttgttgccgcctggcatgtgctcaccctttcctgccctctgcctcgcttaatctggctaacctcactctctaagtctcagctcatgggtgatctttaggaaagccatccctgacagcttctattttccttccttattccccagtgcctaacacttagcaggaactcaataagtaattatttagcaaaattaagactgtttatacaaagatgattcaaaagattgtcctctacagtctagcagcaaagggggtcaacatgtaaagacatgatgtgcaggtcaggtggtaaagtgacactagaaaaattgacaaggtactaagggaccccaacgaagcagacacctgtgtgtgtggagaaagatagctagaatcaaggaagatttcacatagcattctgagcctttttttcttcctctttttggagacaagttcttactctatcacccaggattggagtgcaatggcatgattgagactcactgaaacctcagacttctgggctcgagggatcttctcatctaagcttcttgagtagcggggacaacaggaacatatcaccatacctgtctaattttttgtagagtcaaggttacctatggttcccaggctggtcttaaacttttggccttgagcaattctcccattttggccttccaaagtgctgggattacagatgtgagctattatgcccagcctactttctgagtcttaaaagatgaaaataaatttttcagaatagcaggggaaaacatttgtgatataaaaaatggggtgcacactaattgaggtataaacaacaataattttgcaaattattagtaactgctaactcaattagtgtcttgttaaaaagatactgttatgaagtatagtaaagcattacattgtatattttgactgtatttcaaatttctgttttgtttccaacagttttgttgacttatgttgggtggaacaatttgtgagtgtccctgagattttgcatggcttgaatctggtgatatctggtgtctccccaagtggtttgttgaagttttggataattagaagtatttcttacagaagtaaatatttcagtaaacattgtttcattcaaactctcaaaatataaaatacaaagaaatgttattctctatttatttttataaagattatagtctttatctaactcttcttagttcatttgaactaaatcaatgaatttgtcaacagaacaaaccttaccagtggctttagaggaagagcaagaaaggtgtgaaagaagtgaaaagaagcaatcacaggtatatgaaaatttaagttcttgtttaatattaggttttttttgctttactaacaaagcatagtccaaatgacatgacctttcagactatacctttagaatccaatagatcataattttatatttaatttttaaaacatcttaaccagttatgaaacttaagatattcttactatctctagtaactattagttattctagtaattcttagtatctctagtaactcatagttgtctttacccttggaattgaggcaagaaattttcagaattatcttgctgttttatttatgtaaccttactcataatacacaaggtaacatgaagtattgggtcatattactgaggaatagaaattatgaacagtttaacaacaatggccactgagttaaactagtgttaaaggagtcatcattgccagtgtttcaaatgttgcagttttatattgctggtcaccagtgccgaggttaaagatttattctgttttgtggtcaccagctgacttctgtgtctgtgttcagggagtgaatggggtcataaaagtcaatgcagttgcctattaagagaatcctaccttgcagaatgggacctttggtgtcagggtgtgaacaataactttatttcaacataaatacatagtaaacattactaaaatttaaaaaatccaaaccctatcactaccggaacttaaaatatattagaagtggatataagcagaaattctatctagatacataacactatcatagtatatcatttgaattagaatttaaaattttgcttctctttcttattggtgttcagtttagctcttaataatttagtgtttgcctagtgctctagttcatcttcagaaataaacatgcactgtaggggctcactctttctggtatgctgaggtaaagtctttgtaagagaggaagcttttataatactacctatcatctttgaattcatttctggtagattttacacaaatgcattaagtttagtccaaacagacactgagagttcagcttgctggttcatgtttctgtcctatgttaagccaaggcaaattatttttcactttttagatacaatcccataatttaagagtagcaacacatagattaagtttcacagttaaattttaattattttctaatatttctttgtttatacttgattaaagctaattttaaaacatgcactctgacagaaaagacatctgagaaacaaaacaagcaaatttgttttccattttgcacctgaccccccccaaaaaagtctcaagaaccagaactgggtaagaactgtgataaagggaatctatctatatattcatgactttctttaaaattcattacaaacaagttcaagctgaatattggtaaaagttctgaaaactccaaaattactgcttgccctgaggaagagctcctacatggtaactctaaagagggatgaacaaaaaaggagtgccctctagtgtgatgaatcatgtccctgattgtgaggagaaaaatgtatctggagggtctagctctgtggcagtccaggcagcgcctgaacagaggaagcccatgtcaaatgtctttttattccattcacactccaggtccctgaaatacacttaccagtcatcttctaagcttcatttaaattaaaataaatcagactataaaaatgataacaaaccagacacacagcttgtttctaacacagatgatgaaaatttttgttatgatatagaaactgaaaaagtaaagaacccagtaattatgattgaaatgaaagatgattaagagtttgacatgcaaatggaaaaatgtataaacccaaataccactaattggaaattagacattaggcattggtctcagtctagagatccagaaagtctttttgatttgtggtttacccaccccaaagaaatgaagcatatgattcagatagaaagccacagtatttctgctgctacagatacttataaaaacagaaaaccaacacaatgcttattccagaagccactgaatgacaatcccagtgttaataactacaaaaccatgaatcttgaattataaaatctgggttattctttgccacatagtgagagaacatcaaaaaatatagctagaaacttacagcaagatatttcaaggtcactaacataacacatgtgtacatacgtaacaaacctgcacattgtgcacatgtaccagaacttaaagtataataatagtaaaaagaatgaggtaggcatgttacaagtagagttcctggctttggagaaagagaaagtccaacttcaaaaagacagaggttcacttgctgcttcttttttctctttatcaattatttgatttagtcaaattttctattcaagaaaatcccatgtgtacagttacagcggggttttctaaatgtgtaattatgtgtcaaagtagactagtcctgctatctaaacaatggttcggagaatgttctcataatgtttgttcattaatcaacctaagtctcactctcagtcttccaagtggcatatgagctgggaaactaattcagccatataccatgtgaccttctgaaccagatcaacataaagaaattgctaaagaaataagctttagattctagattctttttactatagtcatttagagatgaattacatttatttaatgatagaatgggaatacaatgggagggaagcaatgactgagatgagccacaaaaacacttctagccttgagagttgcaatgaatattcccagacaaatgagtctgtttaatgtgttttcatgcatgcaagtttatctgcttagctcaaactgtttgaatttatagttccatcatggttatttccaatattttgaaaacaaatatatacttccacatatttaaaaaaatcaccactccaatatttctgttgaatcagaccttacattatgttgtttaataaagtatggtaagttttggcatgtatgatttttatcatgtaagaagcataatttcttagctaaaaatttaacctttgactctttagtagaaagttgagttctgtacactgtgttctaaagatagacaaaaatctagagattttcttctttcaaagtaaaagcagatgaggcctttttccaccctctgaggtgttaaattgctttgctcgttagacttttaatatatctgactaatttgataaatttatctggtaatttatgtaattcagcaacatggaattgtataatgttatttggtgccatgaaatgctagggaatgccgcctcaagagctctggatgaaacatttcgtatgtcttggttggtttgactcccattttcagtagataatatggcttaagtagataactgtaccatatgtgttccacctataaacatttgtggtaactgaatgtgaaatctgggaagcatctcgttttccagaattctgcactaggaactcagcagtttcattctgcttcttgtgttgtggcaaacaaacattggttcccatagttcagggagaactttcacttttttgatatcccaggattcaaaaaaaaaaaaaaaagagataaaaggcagtggggaaaagaatagctcagtgcagaaaagggaaaacttctttactgttcttgaaggcctacaaggttacatcctcttaatctggctatttcatgtaaaatccatgtggcaatgacagaagatatatgttatgcctgtgtctttttatttctctgtttctgccagtcaactagcataaacatttatatcagatagcaaagagtggatgcgaataaaagcacaaaatggagaagagtcctttttgaaattttggaaaattcttccattcactcaaacagaaatgagcagacttgacaaaaatttcaatgataaaatgatgagtatcttataattattatgtataatgataaaattaaagtaagcacaaaatacttttatcattaaaatggtgatagttaacctgaatcaagttaaaaaatcagggaaaaagtttttttattgaataaaataataattattattcatattacttttattaaaggtcaaagaaggaaataatacaaacaaaagtgaaaaaatacaactatcagaaaatgtatgtcatagtacatcttctgctgctgctgacagattaaccaaagaaagaaagattgggaaaacgtatcctcagcaatttcccaagaaactgaaggaaaagcatgataggtaagtaagcctatagcagtttttttttttttttttttttttttttgagatggagttcctctcttgttgcccaagctggaatgcaatggtgtgttctcacctcactgcaacctatgcatactgggttcaagtgattctcttgactcagcctccctagtagctgagattacagacatgtgccaccatgcctagctaatttcttgtatttttagtagaaatgaggtttcaccatgttatccaggcttgtctcgaacttctgacctcaggtgttctgcccacctcggcctcccaaagtgctgggtttacaggagtgagccaccgtgcctggccacctatagcagtatttctcagcagataattgtcattgtgctataaactaattcaaaattggactaatgttcattatgattaacaagttttatagttttaccagggatatttagccctgcctagtaatcagaaaaatgcaaattaacataaaataagatatattttgtaaagtcatgctgatattgaaaaagtaattcctaccattgaaaatgagaggaaaaaggcattctcatacactgttggtatatgaaattggtaaattatttctgaagggtaacttagtgctgtttatcaaaatttcaaataacctgacatccctttaactcaacaactccacttctgggactagatttcacaggaaaacataacttgtgtaaacatacacacacttattaagggcattaattatatattacacataatgaacaatagcttaataaatatataaaatatatgtaataagaaggtgaactggaagtattaagaaagaattagaaaaagtgtggggtaacagatgttagactctttagcctagttttagatgacaataatctgcagatatagtttgtgtgagagatatcttactctgtaaatcatttggagagacacctgcaatatttcatagagatgaaaatttatttctagtgaacttatacgcttgtcaataaatagtaactttaaaaatttagttgattgtaaatgaccttttctaatcaggtagtaattatgactgtgtgatttgaaaaggtaattttgaacttctaactatactgaattatttccagtatctttttgtataatacatactagagtgactagtaataaaaactttagcagaatattctttccttactaattttcaagtatatgcattcgtttgaagatgttgaagtgagaaattaaatatctgagaactacaaaggaaaaataatccagaacatagaaattttactaggatgataaagagcatctgcagaggtagatcacaggatgatctctttattttttaacaaaatgaattttaagataaatgtctttgtctgcagatgcatcttaagacaagaaagtgaagaaaaaacaaatgttaatatgctgtgcaaaaaaatagagaagaattagaaaggaaagggaaacaatataagaaagaagttgaagcaaaacaacttgaaccaactattcaatcactagagatgaaaccgaagactacaagaaatactccaaatcagataaataaatctttggtaaaaattctatattttaaactttattttatcaatgttacttataatatcctcttgatttaatatataatattttggtctaaaacaaaccagaaatgttatctcatttttaaaaaatgaatgatgacacttacaggtacaattatttttattataaatcttggcatccacataggatattattttattacaaagagcttttgaaaacaataatatgccataatatatacttagtgataacctattgataaagattttgttcccagtaaaattgttccttgtacttcctgccatttcatattgattactgtacctaatactataaagaggaaacaaattattgcaatcacaaataatctcatgatattctaagaagagctctataaattttatcttatttaccattggtgttttgaaataaaacttttctttcgtattgatacatttacaccacagaagtaactgtgatctctcagagaactagaagtagagtaagaagtcctggggaaaatcctgtagcttgcttatatttttaacatttctttttcaaatttgtggtaactagatgggttcatcaatgaatgtatataggagtgactagtataatgtctagatttatgatttagtaaatgtaattctttcaactgactataaaagtgttaaaagagtcaaattaaaatagaatgttatcagtgaaacagaactgtaataactctgggaaattttatctgtccaaatatgtgtgaactaaggttcttactatagggtggtgtatgggttagatatcaaagtgtaaatgcaattttttgatatattttaatttagtcaaatttgttaatgctttaatttatgcttttgagtttgttgtaattcagggaaaggcttttccaattctgaaattcttaaaaattctctggtgtgcgtgtgtgtgtgtgtgtttacttttataaattcattgactttaaataaatttctgaactttttggaacttatgctctataaagttcaaagttttgcttcaactttttctccagttggatatccacttacagtaacctttttagtatatggatgtgcaggttatactttagcttcagaggtaatcatgatattttattgagtactagctaaaactttcttttgttttatttaggattttcataatcaggaagaaatgaaagatctgatggatgaaaattgcattttgaagacagatattgctatactccgacaggaaatacgcacaatgaaaaatgacaacctggaaaaagaaaataaatatcttaaggacgttaaaattgttaaaaaaacaaacgctgcccttgaaaagtatataaaactcaatgaggaattgataacaagaacagcattccggtatcaacaagagcttaatgatctcaaagctgagaatacaaggctcaattccgaactgttgaaggaagaagaaagcaacaaaagactggaagctgaaattgaatcatcagtctagactgactgctgctataagtaagcacagtgaaagtgtgaaaacagaaagaaacctaaaacttgcattagagtgaacacaagatgtttccgtacaagtaaaaatgagttctgatatttccgaagtagaagaatgagtttcttactgaacaactttctaaaaagcaaattaaattcaataccttaaaagataagttccgtaagaacagagatactctcagaaaaaagtcattggctttagaaactctccaaacgacctaagccaaacacagcagcaaataaaggaaatgaaagagatgtatgaaaatgcagaagctaaagtgaataattccactggaaagtggagctgtgtagaagagaggatatgtcaactccaacatgaaaatccgtgcattgaacagcaactagatgatgttcatcagaaagaggatcataaagagatagtaactaatatccaaagaggctttattgagagtggaaagaaagaccacatgctagaagagaaaaataagaagctaatgaacgaatgtgatcattaaaaagaaagtctctttcgatatgagagagagaaagcagaaagagtagtaagtatcaaggaagataaatattttcaaacttttagaaagaaaatttaaacatttggttctggatacatgttgaacttagttgaatataaaaatcaatggataaaaagtgtgtttaccatactgtataattccatttacatgaagcatccagaaaagataaacgtatagggacaaaaagtagactaatgtttgcaaagggctggggctgaaagctggtagtgactgctaatgggcgtcagggatcttgcagtgatggaaatgctgtaaagtttgattgtagagatggctgcacaactcagtaaatggactaaaaattcttttaactttaagttaaaacagatacattctatagtatgtaaattatatttcaacaaagctgttttaataaaaaaaaaggaaaaccgtgtttactataccagcttagaaacgtgccccatttctaggaaataaaaggtagaggtgagagatgatttactttgagaaaagacattgtgtcacctatgaaattttattaggcacagagtcatattttaaggtagatagttctgtactgctgaaataataattttaatgactttatgttgccacatgttaagaccataatgtaagtataaatggaaatgtttacacctgaaatgagtattttcaaattaaaatttaattgattatctttgacacttaattctagatttcccagatgaactgaagtgtattgctgtgtcttgtaataccttgctttaagtagctttttatgtattttagttggtatatctttgttattaatcatattaatttaacaaatctgaaaatatgtcaaattacatatttttatgactatgtaatgttttaaaggcacctacttgttataaaatcataatttaggatacatgtggtaatatttagcaaaactatatttggtttagtcttcccactggtatttatagtttactttgaatatttatattaataattagctcctaatttttatttcaaggcttaatgactatcattggaatataattttgttcagtacaaagatacttgtagctgcctgtgatttatgagtaaggcattagatccctattttcagacagaggggtggcaggcttcacgtacagtgggaatggagtaattacaggagggagttgtaggagctttgaagtcagagagggaggtagagacctgtttacctaggacctcaaaggccattggaattttacttttattctgagataggaatctgttggaaggatttgaacaggtgattgaatatgtgaggaactttgaggttgagttgagcttctaagatgattgaatggtgggatgaatctgttatgtaagtaagagaataccaatttggcaggaagagaacatattgtgcatccctcactgaattcagtaataaataaaaatgtgtacatgtgattaaaagaaggtgaattgatatgtgtggtgataattttcaaagtacgtatgttagagttaaatattattaacataatttaataaggcaatttataaaatcagtaacaaaaatattttctcaggtggttgtgagacaacttcaacaagaagcggctgacagcctaaaaaaattaactatgttagagtctccactggaaggtatatcacattatcacattaatttggatgagacacaggtcccaaagaagaaattatttcaagtggaaagtcaagtatgtatggaacttagcatgtcaactgttattctgtagctagttgaattacataacatgttttaggatactaattatggcagaagcttgattttttattttcattacaatgaattatttccactttactatctctataatgtacttatttttttatattgtgactttcattctaccattttgaaaaaccattgcataccttttctcttacaatacgtacccttggaaaagttgagaattatatatcattcctcatagaaaactgacttttgtcctgttaaaagagtatttttaagtaatttttgtattgctctgatgaggcaggccagattaaatcagagaagaatgtttcatggaatgttccagaaaattgtcttatttcttcacttttgtgagtggacacagaatctgtgtctatttatttcacagattctaggttaacttgtacagaaaggccattatactattcttttaaaagtgcatgttttaggttaatttacaaactatttgaaaagttaggcattttctttatcttttatttaaaatatactataaaactgtggaaatatttaaatttgagataacatgtacatcaaaaattgagagttgagaaaattatcttgatcctgccttcggattttaaaaacagtttcactgagatatcattcacatttgagagagttcaaccatttaaaatgtacaactcagtatctattagtaattcacagcattttcatcaccctgaaaagcaacgctacatctcctaggcatgactgcagccttcctccatgtccctccacctacctctgttgtaggcaaccaccatctatctgcttttgtctccatatgttcgcctgttctgcctatttcatatacatagagttatacaatacgtagtcctttgtgactggctttttcacttagcataatgttttcagaattcacttagcataatgttttagcacacattggtagtttatttcttcttacagttaagtgatattctattccatgtctatactggttttccattcattcatcggttgatggacctttaggttagtttccactgtttagctcttatgaaaaatgctgctgcgaacattcacttacaggttattatgtggacacgcgtttttatttctctgccattggactttatcctcagagttaattgggcagatttcagcacttgtcttgctcatgctatcctttctgccttctcagtttctattcatctagcctcattcactcagaagtggcagacaatttattgttttcatgaagctttctctgagtgttctctcattgaccttatgtgttagcaatcgttgtctagtctttgcagaaaaacttagttcttaattttacatggcttttatttttttatggaagatagttttctctcattataaatttgcttaatgggggaataatatataatatgtgtgccacctatccttgcatacattgaaaatattttagcttagaagtttgtagcatacaattcaatactttataccataccaattatttcttctttgagaccttgacacagtaaggtttatattctaagtgtgtttttagcaattaaatatcaaagccaacccaattagtctaatacaggagactcgttcaatcacatgtttatgtttttctctctatgaaaaagaatctaaattggccttttttcactatgcagcagaactgtgtttctggactgctaccagtttgtcagctgaacagttctgggtgcagcttgtccgatgacggatagcacagcccctcaatatgagtgctcagcagagtgcttgtgaaggcagcaccacagcaacagtttctcagagggaacggattcaggagccttgatttagcaatagagtccagggttttcagctcagtgtctttagcctgtctctgctggtcatgtcagttatgtactattcaatccagaaggtgctgtttacattgtagtacatacatagtcattgcctaatgagtcatacagagagaaaagtaagttataaattatgtcccccatttgctgcaactctcagtggtaagaatgattcagtgcagctataggagagtacttccattggcatgccacctgcctaaaatacacaattttgttaagatatacaataaaattattatgctaatagcaaatattttatgtagctcactatgttccacgtagtcttctaagtgtttcatgttagtccccagttaaacacctggttttggaaggctgaagcaggaggatcgtttgagcccatgagtttgagaccagccagagcaatatagtgagaccctgtctctaaaaaaaaaaaaaaaaaaaaaaaaaaattaaacacttatctgaggcatggtggtgcacgcctgtagtcccagctacattgggaggctgtggtaggagggtcgtttgagcttggaatattgaggctgtagtgaacagtgatcaagccgctgcgctccaggctgggtaacagagggagactctgtctcataaataaaacgttttgtatagattcccatagaagtgagttagacatcagtcatagaattattagccactttgatgtctaccttgggagtaaaacatataataaggggcagcgttaaaccatctcaatcactagcctccaacttctcgagaaggttcttatttcatgaatttctacacaaaagactacctggattaagacatttggtggacaccattttgagatgaagaatcttgagtgagaagaagggagttctctacttactgaagcttcccaatgacatagttaagtgtcccccaaaagaaactttagaacaagactttcatcatgccatatctctatggaaaaggaatttctttaaaagaaaacaaaggcaaacaattgataatatgattctcatgggaaagttttcatcataaaagaaaaagagggctgggtgccgtggctcacgtctgtaatcccaacactttgggaggctgaggtgcgtggattagctgaggtcagcagttcaaaaacagcctggccaacatggtgaaaccctgtctctactgaaaatacaaaaattagccaggtctggtggtgtgcacctgtagtcccagctacttgggatgctgaggcaggagaatcacttgaacccaggaggtggaagttgcagtaagccgagatggtgccactgcactccagcctggatgacacagtgtgactccatctcaaaaaaaagaaaaaagaaaaacaaaaaagggacaaagtatactggtccaaaaaagaagaaagcaagaaaaaaaggacaaagtatactggttagtatcataacagtgagatagcccccctttgagattagaaaataacagtatactcaaagtaacattaatgagaaccaacataaaatagacaacattcactatctacaaaagtaatctgcaccaattagcaatgtatgagcatgtggttgagaatattttctataatatgtgtactagaacgaagagacctcaagaaaatggtcagagctggaaatgtagattagggaatctaggtcaaagttttgagattttaggagtcctgagagaatttaaaaagagaaatagccaccaggcatggtggccacacctgtaatcccagcactttgggaggccaaggcatgaagatcatgaggtcaggagttaaagaccagtctggccaacaagtttcttatataggtaaacgtgttccatgatggtttgctgcacctatcaatccatcacctagatattaagccctgtgggcattagttattgatcttgatgctctccctcctgaccccaacaggccccagtgtttgttgttcccctccccgagtccatgtgctcttatcgttcagctcccacttataagtgagaagatgcagtgtttggttttttcttcctgcattagtttgctgaagatatcagctttgggttcatccatatccctgcaaagagcatgatctcattcatttttatggctccatagtattccatggtgtatatataccacattttctttatcccattatcactgataatgtccatctgtgttgattccatgtctttactattgtgaatagtgctgcagtgaacatgcaaatgcatgtatctttataatagaataatttatattccaacgtatggtaattttaaatcagttttggtattaaaaatcatgcattttggaaaatattgataatggaaaaatccaaattctgccaaaatatgttgagaaaatagagggtaaatatatcttttcaaactttaaatgcctcaggctcttagttaatcttccccagatctggaaagacctagaaggggagattgggctaccttaatgagggccatttcaatctcttggccctgcagcagccatttcaaaatacgtcaaaaaatatatttgtgggtaaaatattttgatttccttcagcttcttctctctgtgatgctgcaccagaatcagattagaaaggaagccatattataagtgttaataaaacccatctgatgagatttgatagtttgaagggtgtgtttcccagaccctttagatagaaattggggccaaggaaaacaaggtcttattcctctatataaatctgtcagtgctttaagcagcgaaagaaagatttttcattgaattttacagacttgatactaatgaaaaggatagcttgtaaaatataaatctctttttctataaaaaggacatgttgttgattctcttagaccttgaaccctggccagtgatttgaaaccaagcagtacctatctgcagatctctagtaccaaattaatttggggtggggggtaacaggtttattgagaaataatgaacacgccatgcaattcactcatttaaagtatagaattcattaactttagtattttcagagagttatgccgtcatcattacaattaattttagaacattttcatcaccctaaaaacaaaccccacatcatttagccatcttcactagttttcccttcctccctcagccctagggaaccacccaccttctttgtatagatttgcctataagcctctgaaataaaaagcaagtggtctgctgggactggcttatttcacttagcataatttttcatgctgcatctgtgctgtagcaggtattgatgctgggtttttgctccttagttcagctacatctgtgttcttctctcgtgaccaggaaaaattaagcatgcagacacattgaggagggcagaatttattatgtgaaagcacagctctcagcaaagagaggggtcctgcaaagaggtttccacctcacaattgaataccaggagcacatgagctgaagcggccaggctcctcctctgcataaggtgtgaattcctggtgactccaccccatccccccactgcatgtgggcctccagtctgctgtgggcatgtccaggcaagacaagtccaggttcccttatctgcacataacatctggtgtaaacacttgtggggctcgttggagattctccggggacccttccgtatctgcataggcattttgctgtctcctcctaatacggtatctgtacttaatttcttcttattgctgagtaatattccattgtatggatacatcaaacattttatttatccattcgccaggtgatggacctttgggttctctcccagccaaaggtgacagacgttctggttctttccaccttttgactactattaataatgctgctgtaaacatttatgtatgagtttttgtgcttgcgtatgtttttatttttctggagtatatacttatgactggaatttctgtgtcatatggtaacttcatgcttaaccctttaaggagctgccagtttgttttccaaagtggctgcatcactttacattcccagcagcattagataagggttttaatttctttacatttttcctaacactcttttttcttgaacaaagattttatcctgtggtgtgaagtgataccacatgtggttttgatttacattttcctaatgactaattacattaagcatctattaatgtgcttatccatctttatatcttctttgcagatatatctattcaaaatccttgcccattttttaaaattggcttatcttgttatttattaattgcaagagttatttatatttcctatatatgtaagtcccttatcagatacacgcttttcaaatactttcttctacttggcgtcttaccttttcacttcttcatgctgtcttctgaggcacagcagttttcaattttgaagtccattgaatccatttttcctttggagtcatagctaagaaaacactggcaaatgcagtcacaaagatttatgccagtgttttcttctgagggttttatagttttagcttttacagttaactgttttattttgagttaattattaaatatgatatttggtcgaactttatttattttttgcttatggatacccagttgtcccagcaccatttgttgaaaagactattcttttcccattttgttcttttgttaagcttgtataaaatcaattgactgtaaaagtgcaggcttatttttagattgtcaattcttagcttgtttatgtctattcttatgtcaaggcccaatcgaattgaatgagaagtttttttcaatcatgttgcatattaccagttgtcttatgtcataataaaaattaaatttagtggaatgtctgtaacttcaccttttgtgtcacaaaggagtctctggccagcttataccttacttcctctaagacatgatcagacgccaggcttacaagacacacttaatttctttttttctccattcaagcctttagtctcttttccattgcctcccactatagttatattttcagaaagttttggttacaggatctgctgacatagtctaatattcagtgcattatgttttactaactcattataattcatagaaccttccatagatgtttaccatctaggaaggagaagtttaagtctgagccaccagctttcctcagtggaaatcaagtgaagtcatcatcttgcagtttacagaccctctttcctcctggtagctggttctcttgggtagcactgtggctaatccttttattagtgcagatcttgcattctcagaaaccacagttccctatattgacctccttttactgaaacagagatgcacagctctgctttctagctcagtagaggattcttggaataaaacgtttaactcattccaagaaaaagtcttaggagtgcagcacttcaaaatcaggtaacgttcaggcaatttatcagagacacatagtagattagtattttgactttcaaaatttcagagccaagttgtgtgctatagagaagcattgtggcataacatagaaatgggatggtcttaacttctccatacaaacaagcttggagtaaggtaaaggagaagttgcatttgtgtcttaacactcaaaacacactatgcttattttacttctgtgaagaataaaaatcattccataatattctccttatttcctcatttagaaaagaaaatgaaaattgaatactaggttgattaataaatactcaaaacttcttcttttagaattttagttaattgaaatcaggtaaatgtctgattttgcctatgtcacccagtatttctagttgtttttcaaatcatacatcttcttgcttcccagtcttacttcctaacttgaggggaaattgtaagaagacacccttgccttgttatcagagttcataattgaagttgttttaggaaaattcctcctcagcagcttatgtctctctcctggttatctactgcttctcaataatgtttgacatcaataaataaatatcaacctttattagatcctgctttaaaggagactcttttctgctgcataagttatgtttcctgttgtctctttttaaaacttattttcctaacaattacccagagtcttgtggcttgaaagaaaaacatttattttgttcatgaacctgtggtttgggaaaaacttggccaggacagcttgctctgctcccttcagcttccctaggaacagctgatcagttggggaaatggaatcctctgaagctttggtcacccacttgtttgatggttgatgctggccatcggctgtaaacttggttgggacaggcagcatgaacactgacacaggcactttcaggctctgtttgtggcctgatggctctcacaattggggctgggttccaagggaaaacagtctgagatagggaagccacatggtatccctttcactacattctactcattagaaggaagtcagtaaggctggcccatattctgttttttaaatgggatgaatgtagcttctcttttgttttaattgacacatatatacataattatgggctatagagtgatatttttatacacgtatatagtgtgtaatgatcaagctaactagcacatttactacttcaaccatttttcatttctttgaattgtgaacattcaaaattttctggctttttaaaaatatacaataagtcatagttaaccatattcaccctacaatgccacagaacaccagaactcactcctcttatctaactgtaattctgtatccattaaccagcctcctctcccctacttctgtgagcttttttttgttaagagacagggtcttgctagtgtagtctgggctctgggcaactgtagtcacccagactggagacagtggtttgatcatagttcactgcagcttcaaactcttgggcccatctgatcctcacacctcagcctcctgagcagctggcattatgggcatacaccattgcacatgtctgatttttgactttgtagagatatctccctatgttgcccagggagctctggaacttttggcctcaaatgattctcttgctttggtcttacaaagagcgaggaagttacaggcatcagccatattgcccagccttcaattttcctttagctcccacacatgagtaagaatgtgcagtatttatctttctgtgtctgcacttaacataacatccgtcagactgatccacgtggccacgaataacaggatttaattcctttatatggtgaatagtattccactgtgtttgtgtgccacagtttttcgtccattcatttggtgatggacatgtaggttgattccatacacaagctgttgtggatagtgctacagtaaacatatgaggacagatatccttttgatctattgttttcttttctattgcctgaatacccggtagtggggttgctggatccctcggcagtcccattattagtttttttgagaaaacctcctgttgttctctatagtggctgcactaatttaccttcccaccaacagcatgtaagagtttactgttctctggagcctcaccagcatttgctattttttttgtcttttcaatgacagcaatttattcaaattgaagcaagattatatcacattgtagatttgatttgtatttccctgaggattagtgatactgagcattttaaaatttatttatcggctatttgtatttctttttctaaaaaaaagtatagttagatattttgcccaattttaaactcagattttttttactgtgaagttgtttgagtttttttgtatattttgtatattagtccctcattaggtgaatagcttgacaatattttctcctattctacaggttttctcttcactcagttgtttgctggacagaagctctttagcttaatgtagtgtcttttgtctatgatttgttgtttgcctatgcttctgatgtcttacccataaaaatctttgtgcagactaatgtcctcaagcattttccttatatttacttagagtagtttgataattttgggccttacatttcagtcttcaatcgattctgagtttatgttgttatatggtgttacataggaagctaatatcattcttctccatatggatatttagttttcccagtgtcattcatttgaagaggctgtcctttccccagcgtatgttcttggaatgttcgtccaaaatcagttggctggaaatatgtgaatttatttctgggtgctgtattctatggtctttaccccaagaatcattacttcttaaaatgcaattcaaattagcatgaaacatttgcagtttaaggaaaggcttatagcatcagaatccttaatcatagatttcattattttgtgttgttttttgatatagggtctttgtctgttatccaggcagaagtgcagtgataataattcactgcagccctgaactctgggtacaagccatccttttgcctcagtatcccaactagctgggtctacaggcatgaaccaccatgcccgggtaattaaaaaaaatttttttttgtagagatgggggtctcactatgttgctctggctgatcttaaattcctggcctcaagtgatctttctgccacagctttttaaagtgctaggattacaggcatgagccaccatgcctaatatagagtgtaatatcactttcaaagtcttattcctagacccatttattgactttggcctaaataactcaatatgatatctctgaaactttttttgacatactgtggggaatgataatgaaggaagggggttagacactttttactaggagataactttgtgccatttaaggaggaacaaaaatgaattatcagaaaaataaaagtaaaattaagtacaaaaattctgtggcaaagatgatgatagtaaagaatatatttttatgactcatggtagctttaactttgttcttaaaattctgagtaatttaagggttcacatttgaagaatctgctgcattacagataacattttattgcaagtaaatgcatttcaaaatttgctattggttttgtattagattattctcagcctacttcattatcaagttatactattttattcttgcagtttgatgatcttatggcggagaaggaagctgtatcttcaaaatgtgtcaatttggctaaagagaatcaagtttttcaacaggagttattatctatgaaaaaagtacaacaggaatgtgaaaaacttgaggaagataaaaagatgttggaagaagaaatattaaatcttaagacacatatggaaaacagtatggtagaacttagtaaactacaagaatataaatcagagctagatgaaagggcaatgcaggcagtagaaaaattagaagaaatccatttacaggtgagttgtttaaatcaggtaagtttacttgtaatgtgctttcatttatttcactgcaaattatattttggagatatatatatatataaagagattgcctctcttgtagcaatctgctttgtagagttctagaaaaaaatggtatctgttttttcttttaaatatttaaatttccattattattataacaaaatcaatctttcagagtaatgattctcattatggagtcatttgatgattaagaccagttggcataggaaaaaattgtgttttagaaattatgtgataattatgaattggtcttaagctacagtgttcattgatcactttttaaaactatgaatggattctattactttttatatgaccagattacattaatactagcataattatgatttcaaatttttacaaatcagacttaattctgaattcagttattagttttgatattgctgaaatattttaaacttcatcctcttttttaacatattcaaaaatactctttgaatcgctgactcaaaatgaaaggcaacaaacataataattaggttataattgttttaaaagtgtattcttttcctctgttttaggaacaagcacaatataaaaaacaattagagcagttaaacaaggatatcatacagcttcactaaataagaaggaactcacacttaaagatgtggattgtaaattctacaaaatgaaaactgcttatgaagaggttacaactgagttagaagaatataaggaagcctttgcagcagcattgaaagctaacagttccatgtcaaaaaaattaactaagtaagtcaaaacatacactcatagaaaatgaattaagctcattaatttgtttcaaaagcataatttttagtgagatggcttcaggagattagaaggaagtgaatgctaatttgacaatgtaattttgaaaaataacgtgagtaaataattttacctttaaaatgttagtcaaagatagtttttgtctctcctctcatttttttttttgcttttgtatggctttttttcctgaaaagtctcatataattaacctgatctgttagtttttttcactaagtatttttgaagctttataattaatgaagtgatcttgttataaaattacttgtcagaatttccctaaatagaaatattaatgtgtttaatttacttttcagtggatcacaacctaaatgcaaagtggtactgctactctgggcacaattgtttttgattgtgatctttagtattatcaccagagggtgcctcaagaaagactatttgtgtaacatattcaagatgttacagaaaggcacccttgtgaaatagggaataattatcacaggaatttaaagaagtgtaattcacaaagcggttaaaaaataacaccttgttcagcctgaagcggtgtgtggaaggcagaaagaacatgccccacctccagggccttggtcacagtgttggggactaattgccttcagagatgctttagttctttttgatcaccaaccagacaatctagttctcccctaggagttgttgctctgaattattcctcagtgccaaatgtttaattggtcctagataatgggtgtgtacaagagtgaaatctaaaactggtttactaaacacaagtgttcctagattttttttctttcattttagttttcttaacctacattaaggagtacaacatgatgttttgatataattatttctagtgaagtggttcttataatcaagcaaatcaacatattcattttcccacattattaccctttaaatacaagtatttctaatggaatcttcagaatcttccaagtagagccattttagaaggcaggaagttttacctgttgagccatacatcactgatagccatttctcttccctgtctactttgtttgaactgcttgttcagtagaaatcaccttagaaacaatggtgcttctttagaatgattttaaaattataattccttacaacaggtatgctcttacacatcttctgtgtgaaaacactatttagtgggtaatttggtttactctcagggtaagtttttaaaaactgcaagtcattaagaatcatttaaggaaaaatgaaatattaagcatttgtctttgctacctttacagatcgaataagaaaatagcaatgatcagtatcagctctttatggagaaagagcaggtgaaatattttctcagcactcttcctacaaggtgaggtcgagagtcaccttgtgttgaaaatcttactagtataggactcaacagaaaatatattccccaaatgcccgtaagaattcctacttcaaacctcagacttcaaataactgccagaactacttgactgaggttagttatatgaccgtttctctttagggtttcatttctctagcgtaattcttgtttataatttggtgaaatactgagttgttctgttgacttttgcatgtgaagtaaagatcataattagctgtgttaacacagaaaggaaatgggaactttacattttttaattccctggagctctcattttcaagagatatccatttgctaactttattcaataaatgtgactaaactgacatgattgaaatgtctttaaaagctgcatttaagttaggttttagaaattgcatgttattgcctgataactgatgatatactttgagatgctctggcttactctctaattgattgtagtttagctgtggttcataccacatttttttttctttttttttgaggcagtgtctcactcagtcacccaggctggagtgtcttggtgccatctccactcactgcaacctccacctcccgggttcaagtgattctcctgcctcagcctcctgagtagctgagactaaaagcacccaccattacacccagctaatgtttgcatttttagtagagacagggtttcaccatattggccaggctcttcttgaactcctgaccttgtgatctgcctgcctgagcctctcaaagtgctgggattacaggcatgagccaccgcacccagcccatgccacttttaaagtttctttgcaccagccaggtgtggtggctcatgcctgtaatcccagcactttgggaggctgaggcaggtgtatcacgaggtcaggagttcaagaccagcctggccaagatggtgaaaccccaactctactaaaagtacaaaaaaatatattagcctggtgtggtggtgggcacctgtaatcccagctactaggaaggctgaggcagagaattgcttgaacctgggagacggaggttgcagcagctgagattgcaccactgcactccagcctgggtgacagggcaagactccatcttgaaaataaaaaaaaattaaaaaagtttatttgcaccatctcaattcttcccacccataatcacaactgaatgattagcatccaaacactttgccacatatggatgtttattatttagtagaatccaaaataattgcattttatgaattaaacaaaacactaaaatgttcatttccctttttatgttaaaagctttgtggttggccaggcatggtggttcacacttgtaatcccaaaatttggggaggccgaggcaggtgaatcacctgacgtcaggagtttgagaccagcctggccaaaatgatgaaacctgtctctagtaaaaatacaaaaattagcaaggcgtgttggcaggcatgtgtaatctcagatactcaggaggctgaggcaggagaatcacttgaacccaggagacagaggttgcagtaagccaagatcataccactgcactatagccttggtgatggagactctgtctcaaaacaaaacaaaaaaaaaggtttgtgctttccttacataagagtacatcttctgactataaaaatcctggaaaaaacctaggaaatactcttctagatatcatatttgtcaattaatttatggctaagtcctcaaaagcaattgcaagaataacaaaaattgacaagtgtgatctaatttagctaaatagcttctgcacagcatgagaaactatcacgggattaaacagacagcataaggaatggaagaaaatattcacaaagtatggatatagcaaacgcctattatccagaatccataagagacctaaacaaatcaacaagcaaaaaataaataagaccattaaaaatgggcaaaggacatgaacagacagttctcaaaataacacacataagtggccaacaaacattaaaaaatgcttaccattgctaatcatcagaaaaatgccaaacaaaacatcaattaaataccatttcacatcagtcacaatgacttttgttaaaaacaaataataaataaaaacttaaaaaaggatgttggggaggctgtggagaaaagggaacacaaaccgtttgtggcaatgtaaattaattcagctactatggagagcagtttggaaattaagaactaagaatgactgttggatgcagcaaccccattactatactaggggtatatcgaaaggacaataaatcattgtaacaaaaagatgtatacacatgtatgttcattgcagcactattcacaatagcaaagacgtggagtcaatccaggtacatccaaggtagattgaaaatccaaggtagattggaaaattccatatataccatggaatactatgcagccatgaaaagaacaaaatcacatcatttgcagcaacatgaatacagctggaatccactctcctaagcaaaccaacgcagaaacagaaaccaaatatgtcatgttttcactcatgtgggagctacatattgggtgcacattgtcataaaggtgggaataatagacactgggaaataagaacggggagggacagagtgggccagggttgaaaaactacttcttgggtcctatgctcacaaactgtgtgatgggtttaattgtactgcaaacctcggtatccctcaatatgcctttggaagaaatttacagaggtaccacgttaatttagaatacaaactagaaaaaaaaagaaaagtttcctataagtagagaacagaaatttctttttaagataaaatttattgaagtaaaaaatggattaaatttttataaagggcagagttttctaagaatttcaaagcaatgcattcattgcaaaagatggctttaattacttaatcttttttttttttttttttttgtgagacagggtctcactctgtcaccaggctggagtgcagcggtgcagtcttggctcactgcaacctccacctcctggcttcaagcaattctcctgccttagtatcccaagtagctgggactacaggtgcacatcaccacgcccagctaatttttgtatttttagtagagatggggtttccccatgttggccaggatggtcacgatctcctgaccttgtgatctgcttgctttggcctccccaagtgctgggattacaggtatgagccaccatgcctggccattgtttaacctttgtactaataaaacactacctttctaaaatcatgtatatgcaatagatcaatattaactgcatttttgtcagattactctaaacagcattacacatatacatcctctgttatctaaacttaaaataagtagaaattttattttatttatgtgattatttttctatttaagcaaacttcaagtaatgtctagtcactaaaaatactaaaggccacattttgtaagtgatacatgattttcatgataatgtttcttgtttaatttagacattattattatttttacttattttagatggggctggactgtgtagaataaataattagagaaacaaagagaagtacgttgacaaaatttattaattaaatttaggtttattttagaaataaagtgtaaatagcaaatggcattccttttcattcttgggttagtagatactacatcaatattttttcttacacacatctaatgaaagatgtgaaaacaaaaactttcacagagaagactgcacttatgcaccataaattcatcatgttccaaagcttaaacagttcccaagaagtctgtgcatctcttcttcactggttctacactttcttaagttttgccatcctcatggaactgtcagccagcacactgaaacgattctcagaaaacaaaagcatcatcaagttctcagggtttcggtagagattgaaggccaacagacctaagactcattcagaaatacttagctgagcaataacccttcataagcagtcacttgacaggtgacattttaaatctcctctaatttactgtgtcattggcttacacttgttctcaggaaaagttccaaatttttcaccatgaaataaaaacacccatgtcaatgtaattcttgccaagttactcagccttgtttctcaccacttactgcactctgccctttgctctagcaccaaactggatggagtggaactctgcagggctcttcctcacctcaggctctttgcctttgcctctttcctctatctgggaagctttttcttgtccttcaggtatcaacctatgttatctcctccaccagaaagcccatgatattgacataaaagtgggtagatgtcccttctctgtgttccagtagtgccctgctgtatacctgtcatggtatctatgactctatatggacattgcctgcctgtctgttttttaggttatagcttatgactgttgagaggtggaccatgccatcttcatcttgtaattccagtgctggttctagtaccttagcatgtggctgttgattacatgaatgaagactgaaaaagctctgatatttaaacacaattagaattaatgccatgtgtaaattattaaatagtaattttgtattgtaaatgtacatacatatttctcattcttattaactctgataaagttctcaagtctttagtttttaaactcactcttagttaactgaagtgttttaggtaaagaacaaaattctttatttttctttccagctgttgctgtattggacacttgctcccatctactttcttctctagaatccacgggtaagccacatctaatgaagagaatatttaaccataaagtcttaaggaaaaattctatgatgatttaaaagattataaaactttattactgggctatttacacattttaattgtttctcataaaatatataacattccaatatttactgaagtaggatatttttgtatcatatgtatgattataatttataggatattttaaatgatgttttttggcctccttaagttttaagtggatcttgcaaatgaaaaccagtattattgagtttgacatactcaaattgcccaaatttcagctgtttaaacaaccaagtcatcattgatactttagtaaaggttagtaaatgtcatcgaaggcttatttgcattttacagtttttattacttaggagagttaaggagtacctgccaggtttgtccatgctaatgttacaattttctttttgtagttcaaccgtattttgtatggagatactttgaggctctgtaaatatctggttactcctcagaacccactagatttagcatttcatggatgacttgtgtttgaacaattattactatgatggttaccagatgattattttcttattctcttctttgttctacatggagaaataaaaccaataaataagggagaaagaaagctcatgattctgatgctccaattccccaagattaggccagtagtagacattccaagctgactttatgtctctttgatttgtctccattactctgtcggcacttttttactttctttcagaagatgttctaagctcagcttgtattttctctgcaccagctctggaatgagtcattttttttagaagcagaggtggagccactgaggaaacacaggtgagccctccccagtgtgtactcactggtccccaacagaagaaccactgccacatccactgaagtaccaagaaactagcaaagggacttctggctgtctggggagagtactcatgtggtccctggctgtctcagaggttctggattagtcttcctgtagcctctgtgttgtgtctttagatcggggctctgtgggaagggccctgagagacccaacagcacagcgtgccttatctgccaaatgtccctcccttcctcacactctgacactcaggaatagggtagatggtgtgtccaggcagtgtcaggccacctcactttctcctttgagacgggcccagagggcctttggggtgagtgtggagctgggaacttggagcctgaggccaactgtctctccctgtgtcttggaggaaaggccacgtcccaaaaaaaaaacccagggcctgacctccgggcacacatgcagggagggagggtctatgagctgagggggacattgtaatgagactttgaaccccgttgctctggggcctggtcagtggaccatggtcagagatgacctggtcatcaggacctggtcatttgggacctgatcagcaggggcctggttagtggcagcctcctcagtggggacctggtgacctagtcattggaagcctggtcagtggggggacctagtcagtggtggctttattactggggcctgatctgttggaacataaacaatgaaaaactggttggtggggcatacacaatatatcacgggcctggtcagtgtggggccttagtggcttggggcctggtcagtgagggcctggtcagagggggctcagtcagctgggtactcgttcatggagaattgttcagtggggggtcggttgagcagcaacctggtaaattgtggtcttgtcagtgggaaccctgtcttgtcaatggggaccaggtcagtggaaaattggtcagtggggtctggcccatgaggcctattaagtgtgggcctggttaggaagacatggtcagtggggacttgatcagtgggacttggtcaatggaggagtggtcattaggggtctcatcactcatcactgggaacctggtcaggggcagtttgtcagtacctggcctgctggccactatctgacctcaggcagggaggttgtctgtggagcctccttgcctccatctgcagggaaagtgagtcggggcaccctggagggtcgctggaaagagaaggtgagaagatgtgttgaatccaatactgcttggcagacctacaactttacaaatgacctgtgttccacctagagagtgtgccagccctctcagcattatgcagtgcccctcctctgtctgcatccccagtaccaccatgggtggggagggcagagattggggagcacctatagaggctctaatgctctaaggtgacagtgatgaggacctgggtgcacccatgagtggagaagccaagcctgtccagagaagcaagacaaacacacacatacacacacacacacaggcacacatgcatacacaaatacattgcatacacacatgtcagttcaggggatagaggacactgactctgggccctgttgacccaagcagactcccatggtggtgggttgtgtcaccccacaatgtcactgttgctgagtccccatcgcctctgtgttgtggagcagttagagacacacagcagtgtctgtgagtagctctgcgtgaaggaccattttctagatgagaggcacatctcaacacagctcactgatcagattcaggtgagtgggacctgctcttttctcttcctcctggcttgggaaaagtcactatcaggtgggtggttttggcctctgggcagctactgagggtaatccctgaacactcaccagctgcctgttatgtgctgacagtcatctcattcatcctcgcagcaattccattctgcatcttttctgatcacctccgtgaccacacaggacaaccccatcagggccctgtcaccaggcccagtctagctccatgataaccaagacacaggtccagagacaatcgtcctacattgtgcctgcatctgaccccccttggtaggtagtgaccagcacaacatggaagaagccagggcagcatgcagccagctgctctgcagccccaaatggctcctgggccttgcaagtcattcataaagggaaagctggtcactttgaggtctctgaagggaagggtgaacgtgcatcccaacagccctggcagccagcagcatgccatatatcttctcacccaacctgtgtgacagaggtcccctcctggggcacaagtcccatacctaaagcatcctgtcccagtcggacctcatcctgagccctgggaggggaggggtaccatgggcccccctgcagcagccaggattaccacccaggggactcggccttctgtggccctggccagacttagaatttggcccaagacaaacttactcggagcagcttctcagtacctggggcctgtgcattccaggcaaggccaagctggctcaaagagcaaccagccacctctgcaagggtgtgccaggagcaggtggagcagtcaccaacctcacccactcaaggaaacagggatggccagattcccacagtctgagtgaccacaacctgacagctgatggagcggaggcctgaggaaaagcagatggcactggggctccacttccagggcagaataactgatttaccctgactggcagggagtgacgttggtggctggtccactggctcctggcacaccattgcagaggtgggtggttgctctttgagccagcttggctttgcctggcatgcacaggcctcagtgcaacaaatgtgctgcaaatggagccacatagaggaaatgagcagcaggctcagaactggggtgtgtgccgcctttggggctccagtccaagcatcggggcttctacagcactgtgggcttctcgggtgccaagaggcagaccacaggccatcttgaggaggactctggtaagagcttccttgtgtacgtggatgatgtccagaatgttggcctggtgtccctgagacagcactaacaagtccatgactgggtccagatcctgcctgggctgatgggcaaagagctcactgacagtgtggaaggcatctatggtgaagtggatctatgttcaagtgcagaaagggcccaatcttgtagatgaaccacacagccagcttctggatgcaggtgcagtgccacattgtttgtcacttcctgatgtgctccaccagcactgaagagatagcctggagacagggcaagaggaaggctgagaaggatgagatggtgagtgccagattcttcctggccctgagcccacccccagtgtgacactcaacttttaggcgtgggagagcaagattgacggcttcaagtgcttcaccaagaagatggacaacagggcactcagctcaacttcacagccaatgagtggtggcaggctttgagaaagagcatcagaagcctgacagttcttcagcctcagccaggccttggagctggaccaggccatccacttcagtatagatgccttccactctgtcagtgagctctttgccagtcagtccaggaaggacctggacctagccatggacctgttagtgctgtctcagggacaccagaccaacatcctggacatcatccacatacacaaggaagctcttaccaaagtcatggagagcaggcaacatgtggcagaagggaagacagaggtgcagaggctgatgacgtcagaatcacaggaacaggatttctttggccactttggctgaaattcaccacttccatccaattccagtgagagacatggactcacagatgcagcatttcttgcaacaagagatactactttttcaaaaagtcacccaggaattgatagtgttgaatgactcgatactcgatcgtggacggtttccagttcaaggatactttctacagcagaataataacactagcaaagagctagtacaaggatggttttgtgctcaactgaaatccagttgaatacagaattgtataggaaacagttaatatggtgatagaatagaaacagtagcaatcgtgaactaaatcatactatgaatgcctaaactactgctgtaacttttggaaaaatgataataccactttattgcttttcgaagtatgaatattttagtgtatatgctctagacttaaaactctataaagagtctcaaagaagttggctggataaagcctgctgtggatgtctttatattcaaagattgatgatgcaatttgaatatgtgtccccaccgaatctcatgttgaattatatttcctaatgtggaaggtggatcctggtataatgtgattgaattatgaaggcaaatttctcatgaatggttcagcaccatccccttgtaccatcctcacaataatgagtaacttctcatgagatgtagtcactgaaatctctatatcacctccccactctccgtgttttccccttgccatgtgagacaattgattctttctttgccttccatgattattgaaagatttctgaggcctagaagcagaagcactgtgcttagaaccatgagccaattaaacctctttttcaaaataaatcatacgggaaatggcaaatgaggactggagcgttgctataaagatacctggaaatgtggaagcagctttggaaccaggtaatggacggaggttggaagagtttggagggctcaaaagaagacagatgagaaaacttttggaccatcttagagtctggttcaatggttgtgacaaaaatcctgacagaaacatggacagtgaaggccaggctgaggaggtctcagagagaaataagaagctttctggaaaatgtcttccttttggaaatggaaagcttacacaatgcctgctttttatttcagagactcataggcaaaagagactgtagccttgacccagatgagactttggactttgtaactttgagttaatcctgaaatgagttaagaatttgggagactgctggcaaggcatgtttgtattttgcaatgtgagaaggacatgagattcattgggtcaaggacagaataatacggtttttgtctatgtccctaccaaaactcatgtggaattatattttgtaatgttacaggcaaggtctaggtggaaaaagatttagtcataaaatggtgcaggtagatacttcacgaatgataaagaaccatcaccttgatgctatactcctgataatgagtgagttcccatgagatctggttgtttaacagatctcatcctcctgcttctgctttaggagacatctcattgtcccttggctttctgatataatgaggaggcttcctgattcctcacagaaacagaagacactatacttccttcacagcttgcagaaccatgagtcaattacacctcttttatttacaataatacagaaaagtagaactgcagagaggagctgtgaaatgccttcaaggcctttttccctttgttttggctattagcacagggcttctttatatgcaaatttctgaaatcttcttgaatgtttccccttaaatgggatttttgttcttgctacatagccaacctgctatacagatatctgaaaaagtagaagcaggctcagtagtgggtagcaaacaaggattggaagggtttggagggattagattatgacagggagagggagggagtgatttaatcatggatgggtgggggtggatgtggaagggaaaaaggggtgggtagggtgggagggagtagactggctgtacggtggtgggagggtggtgggtagtaggaaggggtagtagcctgctgcagaggcagagtctcatggaaaatccctactagggaagcgcacctgtggctttgcaggtttgagccccaatggctgctttcatggactggactagtgttgagtgcctgtagcttttccacacggagggtgcaagctgttggtgggtctatgtatctggggtctggagggtggtggccccctgcatgggggctccaagtccatattttccttctgcactgccctagtagaggtttcccaagaaagcttcatctgcagcaggcttctgcctggaaacagtgggaggtgggggtgggaggcaaatccttcaccaatggttaggcaacatcttcttgatgctgtcttcatgatagtgtgttctcatgagatctggttatataacagggggtggcacctctttcctctctcagtctttcttctacccctgccatttgaaacatctcattgccccttggccttctggtatgattggaaggcttcctgatctgatcctcccagaagcagaagccactgtgcttcctttacagcctgctggaccgtgagccaattaaacctcttttctttatgatcatgcagaaaattagtactatgaagtggagccatgaaatgccttcaaggccctttcccctttgtcttggcaaccagcactcagcttcttttcatgcaaatatctgaatccttcatgaactttccccctgaaaatggacttttctgttttaccacattgccaggctgtgataaagatagctgacaatgtagaaccaggttcagaagtgggtaaaagacagaggtcagaagagttgggaaagcttagaagacagcaagatgaggaaaatattggaccactatagagaattgttaaatacttgtgataggaaggctgacaaaagtgtaaacactgaagtccagacctaaaagttctcagatgaaaatgaggaatttcctatgaacaagagacaagattacatttgattggccttagcaaagaagctggctgcatggggaccctgccctggagatctgtgaaactatgaacttgggggtgatgatttaggatgtatctggtgaaatgaacatctaggcagcatagcacaagaggtgtcctgcctacattgaacagcttgtgttcttatgggtgacctaagaagtgacttcaagttggaacttcaagtggagatctaaagtttggaaaatgtggagcctggctaagtggtcaaaaagaaaagccgattttgagggggaaaattcaagaaggcttaggttatttgtataaaaaggaacccagtgcaaaacgccaagacagtgggaaaccggccttgaaagcattttagagatgtctgcagcagcccttgctgtcacaggccctggggcctaggagaaaagaatggtttcctagggcagtcccatggctctgctgctgtgctcaaccgcaggacactgctgccagcatccgtgcagctccagcaccagccatgactgaaagatgcacaggtacagcttgggtcattgcttcagaggtgcctcaaagtcttgatggtttccatatagtgttaagccagtaggtgcacagagaaagagattagaggattgagaactcccatctagactccagaagatgtacagaaaatcctggatgttcaggaagaagcttttccaagaggcagagcttcatggggaacctctactagaggagcaaagaagggacctatagggttgaagcccccacacagggaggcatcattctctaaaccccagattcatagacccataaacagctttcaccctcattgtggaaaagctatgggcactcaacaacagccctgtccatgagagacagctgcggaggctgaacgctgcaaagccacaggtgcagatctgcccaaggccttgggagctcagccctcacagccctctgccatggatatgggacaaggattcaaaaatggtgattttggagctgtagcattaagtgactggcctgctgggttttggacacttatgtatcctatgagtcacccactgcctgtacaatcattgtaccttggaagtagtaaacttgctttacaattcactggctcatgggcaggagggactgtagacttgtctcagataagactctgggctttgtgcatttgagtaaatgctggaatgagttaagatttgagagactctagggaaggcatcattacattttgcaatgtgagaaagacatgaactttgggggaccagagacagaataataggttttggctctctgtctctaccaaaactcatgtggaatgttaatgcaaaatgttaaaggtgggggctgatggaaggtgatttaatcatggtggagagtggaggttggatggttgggggcaccgggagggtgggggggattctggggtggagagggttggagggaatcgggggtggggagggttggaggggattgtggtggggttgggggtgaaaggcaggggtgggggtggatccttcacaaatggttaaacaccatctccttaatgctgtccttctgatagtgagttctcttcatgactttggagctgtgagattgaatgaacactgacgtactggattttggatgtccattgggcctgtggtcccatttgtgttatttttcttggaaatttcttccctttggattgagaaagtttacccagtacctgtaccatcattgtaccttgaaagaaacaaacacccttttaacttcagggactcataagcagaagagactgcagccttgtctcagatgagacttagaactttttacatttgagttaatgcaggaaggagttaagccttttggaaacctttgaaaaggcatgattgtattttattctgtgaaaaggatatgatatttggggggtcaaggtcagcataatatgatttcgctgtgtgcccctggaaaaactcatgtggaattgtaatcccaaattttggagatggggcctggtgggagattatttaatcatggatgggaggtgtaggggtggaagaaaaaaggggtgggtagggtggggtagagtaggctggctgtagggccgtgggagggtgatggatattaggaagggggagtagcctgctgcagaggccgaggctcatggaaaacttctaccagggcagtgcacctgtggctttgcaggctttagcccccatggctgctctcatgggctgggctggtgttgagagcctatcacctttccatactgagggtgtgaactgttggtaggtctatgaatctggggtctcgaggatggtggcctcctgcatagtcagtcaaagcccttattttccttctgcactgccatagtacaggattcccaagagcctctgcctctgcagcaggcttctgtctggaacactaggaggtggagctgtgttggggggcggatccttcaccaatggttaagcaccatcttcttgatgctgacctagtgatagtgagttctcatgagatcttgttatataacggtgtggcacctctttcctctctcagccttgctcctactcctgccgtatgaaatatttcattgctgttttcctgttggtatgattgggagtcttcctgagtcctcccagaagcagaagccactatgctttctttacagcctgcagaaccatgagccaattaaaccccttttcattatgatcatacagaaaataaagtactgcgaagtggagctatgaaatatcttcaatgacatttccccatcgtcttggctattagcactggacttcattttaatgcaaatatctgaagccttcttgaagtttccccctgaaaatggacttctttttcttctacattgtcaggctgcaacaaagatagctgaaaatgtaaagcaggttcagaagtgggtaacagccagaggttggagagtttggagagcttgaaagaagacaggaagatgaaagaaattttggaccatcgtaggcacttgttgaatagttgtgattaaaaggctggcagaaggatggacagtgaaggccaggcttacaaggtctcacatgaaaatgaggaaattactgggaacaggagccaaggttacttttgttttgctgtagcaaagaacatggctgcagggcgaccttgccctcgagatctgtgaaactttgaacttgagggtgatgatttagtgcatatctggtggaatgaacttctaggcagcatagcacaagggggatcctgtctgcatcaaacagcccgtgttcttgtgtgaccgaggttatgtgtgaccgaggaaatgacctcaagttggaacttatatttaaatgacaagcagagctcaaaagtttagaagcatttgcagcctggccaagtggtcaaaaagaaaagctgattttcagggggaaaattcatgaaggctccagaaatttgcataaaatggaggccagtgctaatagccaagacaatggggggaaaaagccttggaggcatttcagagatggttgcagcagcccttggtgtcacagaccctggggcctaggagagaagaatggtttctggggccagccccatggccctgctgctgtgtgcagcctcaggacactgctgcctgcatcccagcagccgcagcacctgctccgaccttggctgaaagatgcacaggtacagattgcatcactgcttcagagggtacaagctataaggcttcacggcttccacatagtcttaagccagctagtccatagagcactagcccagaggcttcagagccttcatatagattttggaagatgtatgaaaatgcctgggtgtccagacagaaggctgccaaaaaaggagagcctcctgggaaacctctactagggcagtgcagaaggaaaatagggggttggagcccccacactggaggccaccatatgcagaccccagattcatagacccaccaagagctttgtacactctgtgggtaaaaactacaggcactcaacaccagcacagcccatgagggcagctgtggggactgaaaactgcaaagccacaggtgcagaccagcccaaggccttgggagtccagccctcatgcccttgtgccctggatgtgggacaaggattagaaaaggatgactttggagctgtaggtttgagtaactggcctgctgggttttggattttcctgggacctgtaagtcccgtttgtgtttcgttgttctctctggcaaaaatcttcctttagggtgggaattcttactcaatgcctggacaatcataccttggaaatagttaacttgctttgtatttcagaggctcaggaacagaagggactgcatctttgtctcagatgagactttgggcttcagacattgaagtaaatgctggaatgagttaagaccttggaggtcttagtcaagacgatggggaaaagtcattgaaggcatttcatagcttcacttcacagtactaattttctgtatgatcataacaaaaaggggtttaatcggctgatggttctgcaggctgtaaaaaaaaaagcatagtggcttggggaattgtaagtaaggcatcactgtattttgcaaaatgagaaggacatgagatttggggaggcagggacagaataataagattcggctgtgtgtcgctatggaaactcatgtggaattgtaatcagaaatgttaaaattggggccaggtggaaggtgatttaatcatggagggaactgggtgttggaaggtggagactggggaggatgggtggattatgctgggggtgaggggtgaaaagtgggggtggggggatgatccctcacaaatagttaaacaccatctccttaatcctttcctcatgatggtgagttctcgtgatggttttggagctgtgagatttaatggatactggtctcctgggttttggacttgcattggccctgtgatcccatttgtgttattttcctggcaaacctctaccctttggattgagaaaacttacccaatgcctgtaccatcattgtaccttgaaagaaaagaactcccttttaaattcagggacttataggcaaaagggactgtagccttttctcaggtgagacgtggaactttttacattcgagttaatgctgaaatgacttaagacttttggcaacttttgaaaaggcatgattgtattttactctgtgagaaggatatgatattgggggatcagggtcagaataatatggtttagctgtgtgtccctacctaaactcacatgtaattgtaatcccgaatgttgcaggtggggactggtgagaggtgacttattcatggatgggagaggggtggggttggaagtaaaaacaggtgggtaagggggggaggagtaggctggctgtagggtggtgtgtagcaggaagggagtagcctgccacagaggcagaggctcatggaaaacctctactaaggcagtgcacctgtggttttgcacctgtggctttgcagggtttagcacctgctgctgctctcatgggctgggctggtgttgagtacctgaagcttttccatactgggggtgtgagctgttggtgggtccatgactcttggatctggaggatggtggcgtgggggctccaagcccatattttccttctgtactgccctagtagaggttttccaaggggatctgtctctgcctcaggcttctgcttggaaacagtgggtggtggatatggggaggtgggcggatccttcaccaacagttaagcacaatcttcttgatgctgatctcctgatagtgagctctcatgagatatagttgtataacaggatgtctcacctctttcctctctctgtcttgcttctactcctgccatatgaaatatttcattgccgcttggccttctggtataattgggaggctttctgagtcctcctacaagcagaaaccactatgctttctttacagcctgaagaactgtgagtcaattagacctcttttctttatgtagatacagaaaattaatgctgtgaagtgaagttatgaaatgacttctaggcgtttcccccattctcttggctattagcgctgagctttattcaatgcaaatattggaggccatcttgatgtttcccctgataatggacttttcttcttttaccatatcgccaggctgcaacaaagatagctgacagtgtagaagcaggttccaaattgggtaatggccagaggttagagagtttggagagcttggaagaagatagcaagatgagggaaagtttggaccattgcagagacttgttaaatagttatgattaaaaggctgacagaaggatggacactgaaggccaggcttgtaaggtctcagatgaaaatgaggaacttactgggaaaaggagccaaggtttttttcttttgccttagcaaagtaattggctacacagtgaccattccctggagatctgtgaaactgaactttagggtgatgatttagggtgtatctggtggaatgaacttctaagcagcaaagctgaagagttgtccggcctacgtcgaacagcctgtgctcctatgtgtgatgaaagaaattaccataagttggaacttatatttaaatgagaagcagagcttcaacatttggaaaatttgtaatatggacaaatggtcaaaaagaaaagctgattttcagggggaaaatcaagaagccttcagatatttgcctaaaaaggagcccagtgctaataattcaagacaatgggaaaaaggccttgaaggcttttcagagactttgtagcagcccttgctgtcactggccctggggtttaggagaaaagaatagtttcctggcccagccccatggctccactgctgtgtgcagcctcaggacactgctgcctgcatccctgcagctccttttccagctccagccatggatgaaagatgcacaggtacagcttgtgtcactgcttcagaggatgcaagctccaagccttggtagcttccacatagtgttaagccagcaggtgcataaagcacaggactagaagcttcagagccttggtctggactccagaggatatatcagaaatcctgagtgtctaaccagaagcttttccaagaggcagagcctcatggtaaacctctactcgggcagtacaaaaggaaagtatagggttggagtccccatacagggaggcaccattttccagaccccagtatcatagacccaccagctgcttgcacccttagtgttgaaaagctacaggcactcaacaccagcctagccaatgagggcagctgtagggggaagattctgcaatgccacatgtgcagagctgcccaaggccttgggatcccagccatcacaaaaccctgtgctctggatgtggacatagattccaaaaagatgatttggagctgtatgatggaatgcctggcctgctgggtttttgacttgcagggggtttgtaagtcccatctgtgttttgtgcttctttctgggaaatttctactttttggcttggaatgcttacccaatgcctgtacaatcattgtaacttggaagtggttaacttgctttgtatttcagaggctcagggcagaagatatggcagccttgtctcagagaagactttggcctttggacatttgagttactgctggacattgggggactgtagagaatgcatcattgtattttgcagtatgagaagggtgtgagattggggggccaaaggagaataatacgatttggctctgtgtccctaccaaaactcatgtggaattataatggggaatgttaagtgtggggcttcgtagaaggtgatttaatcatggtagagaatgggggttggaagggggatgtgggagaatggaggttcatggtgtgggtgagggtgaaacatggggatgggtggcagatccttcacaaatgtttaaatactatctccttaatgcagtctgtgtgatagtgagttctcgtgataaatgaatgctgtcctgctgggttttggagtcggattgggcctgtgtcccatttgtgttatttttctgggaaaaccttccctttggtttaagaaagcctacccaatgcctgtgccatcattgtaacttgaaagaaaagaatttttttttacattcagggactcataggcagaagggattgcagccttgtcttggatgagacttgaacttactacatttgagttactgctggaatgagttaagactttttgaaacttttgaaaaggcatgtttgtatttttctgtgtgagaaggacatgagatgtgggggtgtcagggtcaggataatatggtttggctgtgtttccctacaaaaactcatggggaattgtattcctgacagttgtaggttgggcctggtgggaggtgatttaatcacaaacaggaggttggtaggggtggaagggaaaacaaatgggtaggatggggaggagtaggctggcagtagggtggtgagagtttcgtgggcagtagtaagggggagtagcctgctgcagaggcaaagcctcaaggaaaacctccaccagggcagtgcacctatggctttgcagggtgtagcccccatggctgccctcataggctgggctgttgcttgagtgcctgtagcttttccatactgagagtgcaagctgttggtgagtctatgaatctggggtctgaggatggtaacctcctgtgtggggcctccaagcccatatactttttctgctctgccctattagaggttttcctagtggctctgcctcttcctcaggcttctgcccggaaacagtgaggggtgtgggtggtagggggcagaactttcaccaatggttaagcaacatcttcttgatactgaccttgtgatagtgagttctcaggaaatctggttgtataacagggttatacaacgcgtggcacctttttcctctctctgttttgtttctacttctgccatataaaacatcccattgctgcttggtcttctggtatgattgggaggcttcctgagtcctcccagaagcagaagcctctatgatttatttaaagcttgtagaaccatgagccagttcaacctcttttctttctgattatacagaaaaataatgctataaagtggaactatgaaatgccttcaaggcctttttcctattctcttggcaatcagcactcagcttcttttcaggcaaatgtctgaagcctgcattaatttttctcctgaaatagacttttcttcttttaccacattgccaggctgtgacaaacgtagctgaaaatgtagaagcaggttgagaagtgtgtaatggccagaggttggagagtttggaggtcttggaagaagacaggaagatgaggaaaagtttggaacagtgtagagacttgttaaatagttataattaaaaaggtgacagaaggatggacagtgatcaccaggcttagaaggtctcacatgaaaatgaggagcttgctgggaacaagagtcaaggtcacttttgtttttttcttagcaaagattgttgctgcacaatgcccctaacctggagacctgtgaaattttgaacatcagggtgataatttagagtgtatttggtggaatgaaattttaggcagcaaagcttaagaggtttcctgtctgtgtcgaacagcctgtggtcctatatgtgaccaaagaaatgacctcaaggtgaaacttgtatttaaatgagaaggagagcttaaaagtttggataatttgaagcctggccaagtggccaaaaagaaaagctgattatcagtgggaaagttcaaaaagtcttcagaaatgtgcataaaaaggagttcagtgctaatagccaatacaatgttaaaaaggtcttgaaggcatttcagagacttttgcagcagcccttgctatcacaggccctgaggcctgggagaaaagaatggtttccttctccagccccatggccccactgctatgtccaacctcaggacactgctggctgcattcctgaagctccagctccagccttggctgaaagatgcacaggtacagcttgcatcactgcttcaggggtgcaagcttcaaggcttggtggcttccacatagtgttaagccagcagctgcacacagcacaaaactagaagcttgcaagcctttgtctagactccagagtatgtacggaaaaacctgggtgttcacacaaaatcttttccaagaggcagagcctcatgggaaacttttactagggcagtaccgaaggagaatttagggctggagtccctaaatatggaggcaccattctccagactccagattcatagactcaccaacagctggcacccttagtatggaaatgctacaggcactcaacatcagcccagcccatgagggcagctgtggggtatagaccctgcacagccacaggtgtagagctgcccaaggccttggaagcccaggcatcacacacctgtgctctagatgtgagatgtagattcagaaaagatgatttggagctgcaggattcaatgactggcctgctgggtttttgacttgcatggggtctgtaagtccttgtacatttcagtaaatgctggaatgagttaagtcattgggggacagtagagaagtcatcagtgtattttgcagtgtgacaaggatacaagatttggggagcaagagccagaataatataatttgattctgtgtccctacccatgctcatgtggaattgtagtggggaatgttaaaggtgggaactggtgggaggtgatttaatcatggagaagagtgggtgttggaggtaggggtgtggggagaatgggagagattattttgtgggtgggagtgaaaggtgaaggtggggggcagattcttcacaaatgagtaaacactatctccttaatgctgtccgcacgacagtgagtcctcttgatgattttggagctgtgagattgagtgaatactgtcctgctgggttttggacttgcatttgtgttatttttctgggcaacttcttccctttggattgagaaaccttacccaatgcctgttctaccttgaaggaaaagaaatcccttttaaattcagggactcattggcagaagggactgtaaccttgtctcagatgagattttgaaatttttacattcggaatgagttaagacttttggaaacttttgaaaaggcatgattgtgttttgctctgtgagaaggacatgaggttctggggaatcagggtcagaataatatgggttggctgtgtgtccctataaaactcacgtgtcatccttaatgttggaggtgggccaggtgggaggtgacttaatcttggatgggagggggttggggtggaaggaaaaggagggatagtgtggggaggagtaggttgtcagtagggtggtgggagggtgggagtaacctgctgcagaggcagaggctcatgggaaacctctactaggagagtgcacctgtggctttgcagggtgtagcccccatggctgctctcatgggctgggttggtgttgagtgcctgtagcttttccatactcagagtgtgagctgttggtgggcttattaatctggagtctggaggatcgtggcctcttgtgtgggggctcaaagcctatattttccttctgcactgccatagtggaagtttcataagaggttctgcctctgcaggaggcttctgcctggaagcagtgggcggtggtgtggttggagaatccttcaccattggttagtcttcttgatgctgatctcctgatagtgagttctcatgtgatctggttgtctaacaggatgtcacgcctctttcccctctctgtcttgctcctactcctgccatatgaaacatctcattgcctcttggtcttctgatatggttaggaggggcctgatcagtgtgggcctgctcaggggacctagtcagttgggacttgtcagtgaggcctatttagtggggggtggtcagcaggggtctgcttagagtgggtctcattagagggatctagtagtgcatgccttggtgagtgggttgatagtggtagacaaatgtttggtgtctggtcagtgccaacctgggctgtgggacttggtcagtggagaccttgggacctagtcagcagagacgcttgtcagtggggccctggtcagggcaggctggtccttggaacttaatcagtgggggcctggtcagagaggacttgatcattggtggcttttgtagcactggtctacggggtgacctggtcagcggggatctgagcagtgcgtgcctgttcagtggggcgtagtcattagggtcccagtcaggagcatcttgtcacctcagtcctggttagcaggggcctggtcactggctgcctattccctgcaggcctggccagtggggcttcatctgtgggaccagacaatggggtcatgatcggtggaacctgatcagtgaggccttgtctgtaaggacctcgtcagtgaggccttgccagtgaggccttgccagtgaggccttgtcagtaaggtcctcgtcagtggagtcctggtcattgtgggcctggcagcgggaatctagttagtgaggcctggtgatggggctctaatcagtgagggtgtggtcagggaggaagtgatatgctggaactggtcaccagggacctggtcagtgggggctgctgagtactgctgggagatgtcaggggaaatgcatgttatcgaggagcctgtggacagctggggtggcccagtggtgttcaatggcccagtcaaaagtggacaaagcaggtgtttggatggacctgggagatcttgctcagagattctgacaggacaaaggtaaaggaagggccagagtggtcggagagatagtcacagtctatggtctgcacaggatggaggaggccagggaacaggcagggtgggcagcttggtttcagggagaggcaggtgcatgctgggaggtcagaccctatgagggttgtgggggcgtcaggtggtgtgggctccaggtgcaccctcagcgcactgggcaggtcttggcccaggctccctggaccttggtcgggtgatgtggtcacttgctgggagactgttgtcaggtgctggacacccactctgggtagcactgtcccatctcaggactggacttcctcagatactgcagagggcacagcctccagcacaggaggggaagccccttggtgcagcctgagctctccatgggcctggagcatcccctgccagccctgcactccctcttctcccaggtcccacttttccagggtcagccagtggggaggccccgtcctcacttccctatgtgtatcctgggctgaaacttgcagtgcactgggacaggcatgaggcttccctaaggcccatttagggagaggactggctcccagcctggcacaggtcctcagctctgccttggttgccttagaatgagatgtaccagtcagtgccctgaaggtaaaggtaggagactgtccctgctgttgggaggctggtctagggatggaggacttcacaggtcctcccagtctgtcaggcctgggcagcactgtcctgttttaggactcagaaagtccagttctgggatgggacggtgctgcccagggagggtggccagggtctgacagcagtcccccagggagtgaccacatcacccagccggggtccagggagcctggcctgagacctgccctgtgcactgagggtgcacctggagcccactccacctgatgcccccacagccctcacaggtcctgacctcccagcatgcacctgcctctccctgaattccagctgtccaccctgcctgttccctcacttcctccatcctgtccagcaggatgggatgggcagggggacagactgtgtgcacatttcatggcaagcaggagtgacacaccatccctgggaggcgtcttggttcctccaaaacccggccccagaactctgtccttggggtggttttaccaaaccccaaacccagaactgtggttgtggctcaggggtcagcacccgctagttctacaatgttgccaaggactttgattgtacaatgttcttcttttcaatagtcattccaaatattgtgagatgcactgtttcaggaagtcccttgccctcctaaaagccaccctacttctctctaaggagaatggcccagtcctctcccgagttcacacatggtaggcgatagcattgcttttgtgtaaattacataatgcaaatttttttaaatctttgccttaatacttttaaattttgttttattttgaatgactagccttcatggccccacttttttgtatcccaacttggaatgtatgaagggttttggtctccctgagagtggttcgaggcagccagggcttacctgtactctgacttgagaaaagttggataaaagtgttcaccttaaaaaaaattgaatgacgaagcattaacaaaaacagtatttcagtacagtggacagcttagcattttgacaattgggaataaaatgctcatttctgaactgtacaatgtaagacacaaaaacaaaacactggaaatggaaattcaattgtcattatagactggatactgctctacatgactgtgaccaaagtcagatagttgaaagagatttctttccagagaacaagacatgaacaggtttatttacagaaaacaatgaattctcatatatctaacctaaaatatagcagattctttccgaacaagtctaatgtagacagtaaaattaataggctaaaaattaaactccatcaaacaagatgaactctgagagaatagatggggcaggccgccatctttccggttcaggcaacttagtcattccagcctgagggctttggagagtataaaccgacaaggggcagaagagatcccacagcacagcatagctgctttaccaaatcatggccagaatgcttctgtaagcaggcccccgaccctgttgcacatcactgtacaggacctcccaaatggggcctccagctaccgccaccagcattccttggccaatagaaatttgaagtgttcacgggacagagctcccagagagaggggcaggccaccacctttgctgtttgggtgactagccgttctggtttgcgggctttggaaagcccaaggtgacaaggggtggaagaggaacctcagcgcagcacggccacactacaaaaacgtggccagactcttgtttaagtcagtccccgaccacatttctaatcagcaggtgaagcctttcaaccagggtctccagctgccttcactgctgttctctggccgacagaggtttcaggcctccctgagtcagagctcccagggggaggaccagactgttgtctttgctgttggggcaactcagccatttcagcattagggcttcagagtgtctgaggcaaccaggagtggaagggaacacccggcatagcacagctgctctagaaaaacatgcccagacttttttttttttaactcagtgcctgtttttgttcctcctgactagataagacttctcaacttgtctccagtcacatcttataggtgtgttcatactggcaacaagttcatacctcagtggcacagagctcccagaggaaggggcaggctatcatcttccctggaaaatacaaggcagttagggactggaggggacccccagcataccacagcagcctgacagaaaagtggccagacagtctacttgatgggcaggtcctactgacctgggtctccagccagtccaccatcagagctatccagccagtagcaactcagcaattccctggacagagcttccaggagcaaacgaaattctctctgccattgcctccgcagtgaaactgcccttgctaccctcagaatatcaagggagcaaagaccctaagtgccatattgacacctccaataagctgcggttgacccaatgaacaagccagtccatctcccacgggtaccacacaccccccactgctcatcaccagagagggaacactggcttggcctcacaacacagaccctccatcctgggctgattactctaagtgattgctaactcacatctctatgggatggagtacccaggagacaagcggagtggtggagcagcaagtcaggtgatgtggagcccagagagcagggacacctatctctctaggctccacgtgcccttgtgagatactttatcccagcactttaggaatgctaagttcagatcagccccatctcatgttcaagattgcccagcagagatcaggtcccagagttcccctcctcaaaaaggggacttgcttaaaaaagaagcctggccatgtttgtgtaaagcagctatgctgtgctgggggttcacttttgagagagttctcctctgagacctgatctctgctgggcagtcttgcacatgagatggggctggtctgatatcagcactcctttgtctgcttgcctctcccaggaccccagcctggccacacctgcatacagggcactctcggatgcccacagcatagcttccgtgctagtggactgtacctgatcagtggagagctgcagcaaggtggccccaacagccacgcaccagcctgcacattacgtctccatactgcagccctttatatggaaacttcctacatcactttgctgtgtgtgtttacacatgtgggttttgctgtacttgccctgacagcacaggggagtgcaggacacaccccaacccacaccaactgccattgaagacagagccttggtgggcacagaaccaagaaccccacccctgccagcacctaacccttgagctaattctgtgcagagaaaaagggaccttcttataccctgagtgaccactgttgctttgaggggcacagagaaggcaccatggcctgcactggccagcagcccaccctgaaccaacactacctccagtgcaacacacacacagcaggggacccctggcccacaccccagctgtcttgcctccaccactgggtgaatgcccgcagggaggcagggacttttgcatccactagcattctgccacagttgccacactttggtcccctcagtgcagtggactccaaacctccaagagccagagaacaaagttggggcccaagacaagttccccagagttaaagcacacagtccaggaattggaagctgcacattggcccccctaaaatcctccaaaaacaaagccagttggttgaatccaccttatcccacaatgaaaccctcaagatcatcaaatacaataaaacaaaaataccctgtccgaaggtcagcaacctcgaagatggaaggtggataagcccataaagatgagaaagaatctgtgcgagaacactgaaaactcaaaaagtcagcatgctttctttcctccaaatgactgtatcaactctccagcaagtgttcagaactgggctgaggctgagctgtctggaatgatacaagcagggttcaggatatgcgtaggaacaaagttcactgagtgaaagaagtatgttgtcatgcaatacaagtgagctaaaaatcattgtaacacattgtaggagctaacagacaaaatagcaagtataaagaagacataaccgaccgaatagagctgaaaagcacactacaagaattttcataatgcagtcacatagtgattatgtgtgattgcattatgaaaattattgtagtgtgtgtgggcacctgagattgccctgtaagcaggtgtggccaggctggggtcctgggagaggcaagcagactaaggaggactgtcacaccagctccatctcatgtgcaagaccacccagcagaatagaccaagcagaggaaagaatcccagagcttgaaaactggctttctgaaataaaacaggcagacaagaatgggggaaaaaagaaggaaaatgaatgaacaaaacatccaagaaatatgagattatataaacgaccaaatctatgactgattagtgtacgtgaaagagatgaggagaatggaaccaacttggaaaacatacttcagaatatcattcatgagaatatccccaacctatccagacaagccaacattccaattcaggaaatccagagaacctcagtaagataagccatgagaagatcatccccaagacatataatcatcagattctccaaggtcaaaatgaaagaaacactgttaaaggcagctagggagaaaggcaacgtcacctgcaaagggaattccatcagacttagcagacttctcagctgaaaccctacaagccagaaaagatattcaacttcttaaagaaaagaaatttcacgtagtatggcagagacagatataccatataataacatggtgttattatacatggttaaaagaaaaagaaatttcaacccagaatttcatgtccagcaaaattaagcatcataagtgaaggagaaacaagatccttttcagacaagcaaatgctgagagaattcattatcaccagatctaccttacaagagctcctgaatgaagcactaaatatggaaagaaaagaccatcaccagccactacaaaaatgcaccgaagtacacagaccagtaatgctaaaaaccaaccacatacacaagtctgcaaaataactagctgacagcatgacgacaggatctaatccacacataccattactaaccttaaatggaaatgggctaaatgctccgattgaaagacacaggggggcaagctggataaagaacaaagacccatttgagtatgctgtctccaagaaacccatctcacatgcagtgccatacataggctcaaaatgaaggaatggtgaaaaatctttcaagcaaatggaaaacagaagaaatcaggtgttacactcccagtttcgacaaaacgtatataccaataaagataaaaaaagacagagaaggtcattacaaaggtggccctgacctttgataaatctcgttattgattgataccaacatgggctatctttattgcccaaaccaacaggataatttgctgaggttgtggagcttctcccctgcaaagagtccctggtctcccaaaatctggttgagatctaagtttgatttttctgtacaactccttttctgaagttttactcatttccaacaaggaaggcaagttttcctgcttctgtggtgatggagagcaggcacctcctttcctgagtttcagcttgcttctgacagggaaggtgagtgtaagttgttttcagcttctaagatggcagagaacgatcaccagcctgagccttgtttccaggtgagtagctgaattagagttttgtcttaaaatttgtccttaatgactaaaatttaagattactcaccagctgcttttaatttctgcttttagtttctccttaccattagaacactcagtaatcatatgaattgtgcatttgttgttttgcttaactctttttgtttgtttatgcttggggctttattgttgtttcacttttctcccttctcttcctgacttggtcaaatccaaaggaattttccaaattgtggggagcaaggcctctgaattggctaaaactcctatggctgcaaacaaacaaacaaacaaataaacaacaacaaaaaacattccagttagcagaaattattttttaaaacttttttttttttacataagtggtctcatctacataacaaggccacccttttgctagccaaggctaaactgaaggagtagtggtggtgacccagtgtgaagattctgccctgttcactacagaaacctgagtttggttcctaagtctagttctttctgtttgatatttatgttacttttaaagcgtcagcggtttgtcccagctatgatgtggtaataaaagattcaaaaggattttcttcacaagttctatgattaaaagcttaattaaaagcaaatttctttttttttttaaattatactttaagttctggggtacatgtgcagaacatgcaggttacataggtatacacatgccatggcggcttgctgcatccatcaacccatgatctacattagttatttctcctaatgccatccctctcctagccccccaccctgacaggccctggtgtgtgatgttccccttcctgtgtccatgtgttcccattgttcaactcccagttatgagtgagaacatgtggtgtttggttttctgttcttctgttagttagctgaaaatgatggtttccagcttcattcatgtcccagcaaatgacgtgaattcatccctttttatggctgcatagtatttcgtggtgtatatatgccacattttctttatccagtctatcattggtgggcatttgggttggttccaagtctttgctgttgtgaacagtgccgccataaacagacaggttcatgtgtctttatattagtatgatttataattttgggggtatatacccagtaatgggattgctgggtcaaatgatatttctagttgtagatccttgaggaattgccacactgtcttccacaatggttgaagtaatttatattcccaccaactgtgtaaaagctttgctatttctccacatcctctctagcatctgttttttcctgattttttaacgatgaccattctaagtggtgtgagattgtatctcattgtggttttgatttccatttctctaatgaccagtgatgatgtgctttgcttcacatgttcgttggctgtataaatgtcttctttggtaagtgtctgttcataccctttgctcactttttgatggttttttttttcttgtaaatttgttctttgtagattctgcatattagccctttgtcagatggatagattgcaacaatgttctcccattctgtgggttgcctgttcactctgataatagtttcttttgcactgcagatactcttaagtttagttagatcccatttgtaaattttggtttttgtagccattgcttttggtgttctagtgatgaagactctgcccatggctatgtcctgaatggtattgcctaacacaaggacatttctgtgcctgactgctataccacccaaagtaatttatagactcattgctgtccccatcaagctaccattactttcttcacagaattagaaaaactactttaaatttcatatggaaccaaaaaagagcccacatagccaaggcaatcctaagcaaaaacagcaaagctagaggcatcacagtacctgacttcaaattattctacaaggctacagtaaccaaaacagcatggggctggtaccaaatcagatctatagaccaatggaacagaacagagccctcagaaatgacaccacacatctaaaagcatctgatctttgacaaacctgacaaaaacaagcaatgggaaaggataccctatttaataaatggtgttgggaaaactggctagccaaatgcagaaaactgaaactgggccacacccatacaccttaaacaaaaattaagtaagatggatgaaagagttagaagtaagacctaaaaccataaaaaatctagaagaaaacctaggccaccaacctcaggggaaatgacctgtagtgaaatgcatggtacaaacatgcattccctgcttcctttagtgggcaacgttgatggctagtccaaccacttcaggcacacccttgcaaacgcggctggttgctttttgagccagcttggccttgcccggcatacacaagcctcaatgcaacaactttcctaaaaatggagccccacagaggaaatgagcagcaagctcagaagcagggtgtgcactgcctttggggctccagtccatgcctcagggcttgtatgggactgcaggattcttggttgccaagaggtagaccatagaccagccgaggaggactttatgttcaagggcagaaagcagccaggtttaccacccaggggactcggccttctgtggccccggccagacttagaatttggctcaaagcaggaccagctcactcggagtagtgtgtcagtagctggggcctgtacatgctaggcaaggctaagctggctcaaagagcaaccagctaccactgcaagggtgcttctggaggaggtggagcagccagcaacctcagctacacaaggaagcagggatggccaggttcccacagcatgagtggccaccgcctgatggctgatcaagcagaggcctgaggaaaagcagatggcagttgggccctacctctagggtagaagaactgatgtactctgactggtagtgagtgaggttggtggtgggtccaccggctcctggcacacccttgcagaggaggctgtttgctctttaaggcagcttggccttgcctggcatgcacaggccccaggtactgacacgctgctcccagtgaacttgttctgccttggaccaaattctaagtggcttggagtttgcccagcatgcacaagcctcagtgtaataactgtgcaacaaacggagccacatagacgaaacgagcagcaggctcagaaacagggtgtgccctgcctttggggctccagtcaatgcctcatggttcctatggcactgcgggtttcttggttgcctagctgcagaccacaggctgtcttgaggaggactttatgttcaagtgcagaaagtagtcaggattaccatccaggggactctgccttctgtggtcctctccagacttagaatttggcccaaggcaggacaagctgactcggagcagagtgtcagtacctggggcctatgcatgccaggcaaggccaagctggctcagagcaaccagccacctctgcaaggctgtgcctgtagcaggcggacaagccagcaacctcacccgctcaaggaagcacggatggcgaggttccaacagcatgagtggctgccacctgatgcctgatggagcagaggcctgaggaaaagcaggtggcatatttaactctttaatcaatcttaagttattttttgtataaagcagatggcactagtccatgcctcatggctcatatggcactgcgggccacagaagggcgagtacccagggtggtaatcctgcctgctttctgcacttgaacataaagtcctcctcaagatggcctgtggtctgcctcttggccccacctttagggtagaagaactgatgtaccacgtctggcagtgagtgaggttggcagctggtccatctgctcctggcacacccttgcagaggtggctgcttgctctttgagccagcttggccttgcctggcatgcacaagcctcactgcaacaagtgtgctacaaatggagccatatagaggaaatgatcagcaggctcaggaatggggcgtgcactgcctttgtggctccagtccatgcctcagggctcgtatggcactgtaggtttcttggtcgccaacaggcagaccacaggctttcttgaggaggactttatgttcaagtgcagaaagcagccaagattagcacccaggggactgggccttctgtggccctggccagacttagaatttgacccaaggcaggacaagctgactcggagcagagtgtcagtacctggggcctaggcatgccaggaaaggccaagctggctcagagcaactagccacatctgcaaggctgtgcctgtagtaggcggacaagccagcaacctcagctactcaaggaaggagggatggccaggttcccacagcctgagtggttgccgcctgatgactgatagagcagaggcctgaggaaaagcatatggcactggggccctacctctagggtagaataactgatgtaacctgaccagcagtgagtgaggttggtggccggtccaccggctcctggcacaaccttgcagaggtggctggttgctttttgagccagcttggccttgcccagcatgcacaagtctgtgcaacaactgtgacacaaatggagccacacagagaaaatgagcagcaggctcaggagcagggtgtgtgcttcctcgggggctccagtccatgcctgaggattcatatggcactgcgggcttcttggttgcaaagaggtagaccacaggccatcttcaggaggtctttatgtggaagtgcagaaagcagccaggattaccacccgtgggactcggccttttgtggccctggcctaacagaatttggcccaaggcaggacaagctcactcagagcaacatttcggtacccggagcctgtgcatgctaggcaaagccaagctggctcaaagagcacccagagcatccattctggtggaggagccaaccacatggccagcttctgggtgagggcacagtgccacatcttccatcactttctgatatatcccaccagcactgaagagacagcctggagagagtgcaagaggaaggctgagaaggatgagatagtgagtgctggcttctttctgaccctcagcacatccccaggtggtgaccatcaacctttaggggtgggagagcaagattgatggcttcaaatgcttcccaaagaagatggacacaggccactcagctcaacctcacagccaatgagttgacaagcaagcagatgacagtgacaggcttttagaaagagcatcagaaggtggccagtttttcttcagcctcagccaggccttggaagttgactaggccatccacttcaccagagatgccttcaagaacatcagtaagctccttgccggtcagtccaggaaggacctggacccagccatggacctgttagtgctgtctcagggacacaagacaaacatcctggacatcatccacatacacaaggaagctcttaccaaagtcacggagaacagacaacatgtggcagaagggaagacagaggtgcagaggctgatggcgtcattatcacaggaacaggatttctttggccactttggctgaaattcaccacttccatccaattcactcaagtgagagacttgaaatcacagatggagcatttctttcaacaagagatactattttttcaaaaagtcacctaaaatttgatagtgttgaatgactagctattcgagtgtggactttttccagttcacgggtactttctacagcagaatgataacagtatcaaagagctggtgccagctatcggtggtagtacaaggatgactttgtgctcaactgaaacccagctgaatatagaattgtgtagggaagtgttaatatggtgatagaatagaaacagtagcaaatgaactaaatcatactatgaatgcctacactaccattataactttttgaagaatgataataccacttactttattgccttttgaagtaggaatattttagtggatatcctatagatctgaaaccttataaagaatcccaaagaagctggctggataaagcctgctatggatgtctttatactcaaagactgatgaggcaattcgaatatgtgtccccaccaaatctcatgttgaattatgcttcctaatgttggaggtggatcctggtataaggtgattgaatcatgaaggcaaatttctcatgagtggttcagcaccatccccttggtactgtcctcacaatcatgagtgacttctcgtgagatctggccactgaaaactctatatcactccctactctccgtgatttcctcttgccatgtgagacaattcactctttcattaccttgcacaatgattgaaagatttctgaggccccccagaagaagaagcactaagcttcctgtccactctgcagaaccatgagccaattaaacctctttttcaagataaatcttaccaaaaatggcaaatgaggactggagcattgctataaatatacctgaaaatgtggaagcaacttcggaactgggtaatgggtagaggttggaagagtttggagggctccaaagaagacagacagatgagaacatttttggatcatcttagagactggttaaatggctgtgacaagaatgctgacaaaaacatggacagtgaaggccaggctgagggggcctcagataaaaataagaagctttctggaaaatgtctctcttttggatatggaaagcttacacaatgcctgtaccatcattgtaccttagacgcagtgaacttgctttttatttcagagactcgtaggcaaaagagaatgtagccttgacccagatgagactttggactttgtaactttgagttaatgctgaaatgagttaagactttgggagactgctggcaaggcatgactgtatcttgcaatgtgagaaggacatgagatttgtggggtcagggacagaataatacggtttttctctatgccccttccaaaactcatgtgaaagtacactccctaatgttagagtcggggcctaggtggaaaaagttttaatcataaaggggtgggagtggatccttcacaaatggcaaagcaccaagcccttaatgccatcctcctgatagtgagtgagttctcatgagatctagtagtttaaaaggctgtggaacctctttcctctctctgtcttgttccaacttctgccatatgaaacatgtcattgccgcttggatttccggcgtggttaggaggggcctgatcagtgtgggcctggtcagtggacctaggtcagtgaggactatttagtgggatcatggtcagcagaggtctgcttagagagggtctcattagtggggtctagtagtgggggttttggtgagtggggacctattggctgccagttgtttggtgtctggtcagtgcaaacctgggctgtggggcttgatcagtggagacctggtcagctggggcttagtgctggcctggtcagcatgggctggggcactggtgaccaggtcaaggggtgctattcagtggaggactgggcacatggaacctagtcagcagaccctggtgggcgtgtcctcatcagtgaggcccttgtcagtggggccctggtcagggcagccttgtcagtgggacctaatctgtagtgtcctagtcagagaggacttggtcagtggtgacttttgtagcaccggtctacagggtgacctggtcagcggggatctcagcatttggtgccagttcagtggggtctactcactagggtcccagtcaggggcatctggtgaccttaggcctggttattaggggcctgatcagtggcaacctgttccctggaggcctggtcagtggggcctcatctttggggccagggaatgaggtcatgatcagtggaacctgatcagtgaggccttgtcaataatgacctactcagtgaggacttgtcagtaaggacttggtccgtgaggccttgtcagtaaggtcctggtcggtggagtccttgtcattgtgtgcccggcagtgggggccttgttagtggggcctggtcatgagggtctaatcagtgagggtgtcatcagggaggacctgatgtgtggggtctggtcagcagggacctggtcaatgtgggctgctgagcactgcttggataagccaggtgcaatgtgcattattgaaggccctgtggacagctgggatagcccagtgatgcccaagggcctagtcaaaagtggacaaagcacgtgtttggatggacctgggagatcctgctcagagattctgaaaggacaaaggtaaaggaagagccagagtggctgcagagatggtcacagtctatgggctgcacaggatgaaggaggccagggaacaggcagggtgggcagttggggttcagggagaggcaggtgcatgctgggaggtcagaccctgtgagggctttgggggcgtcaggttgggtaggctccaggcactctcactcacataggattccagaacactgctacaaggctctgagtgtttgtccctcacgtaggattccagaacactgctgccattgtctgaatgtttgtcccccacataggattccagaagcctgctgctggggtctgaatgtttgtcccccatctaggattccagaacactgctgtgagggtctgaatgtctgtccctcacatatgattctagaacagtgatgctagggtatgtttgcccttaacatatgatttcaaaacactgctcctggattctgaatgtttgtccttcacataggaatacagaacactgctgctggagtctggaagtttgtcactcacatagaattccagaacactgctgtgaggatctgaatgtttgaccctcacatgggattccagaacactgctgcgagggtctaaatgtctgtccctcacataggtttcccgaacaatgttacgaggttctgaatgtttgtccctaacataggatttcagagcactcctgctgtgctctgaatgcttctccctcacataggattccagaacactgctacgagggtctgaatgcttatccctcatataggattccagaacactcctgctgtggtctaaatgtttgttcctcacataggattccagaatactcctgccgtggtctgaatgtttgtccctcacataggattccagaatactcctgccgtagtctgaatgtttgtccctcacataggattccagaatactcctgccgtggtctgaatgtttgtccctcacataggattccagaacattcatgctggggtctcaatgtttcccttaacataggatttcagaacactgctcttggggtctgaatgtttgtcactcacataggattacagaacactgctgctggagtctgaatgtttgtcagtcacatagaattccagaacactgctacaagggtgtgaatatttctccctcacctagtattccagaacactgttgcaagtgtctgaacgttggtccgtcatataggattccagaacactgctgctgtagtctgaatgtttgtccctcacatagaattccggaacactgctacaagggtctgaatgtttgtccttcacataccattccagaacactgctgccgtggtctgaatgtatgtccctcacataggattccagaacactgctactaggttctgaatgtttttcccacacctaggattccagaacacttctgctggtgtctgaatggttgttcctcacatatgattccaggacactgctatgagagtcttaatgtttgtccttcacgtaggattctagaacactgctcccgtggtctgaatgtttgtccttcacatagcattccagaacactgctgctggggtctgaatgtctgcccctcaaatcagattccagaacactgctgctggggtttgaacgtctttccctcacatagaattccagaatatggctgggagggtctgaatgtttgtccctcacatgggataccagaacactgctgcgagggtctaaatgtctctccctcacataagatttcaggacactgctacgaggttctgaatgtttgtccctcacataggattccagagcactcctgctgtggtctgaatatttgtccctcacataggattccagaacactgccacgtgggtctgaatgtttgccctcacataggattccagaacactcctgctgtggtcggaatgtttgaccctcacataggattccagaacattcctgctgtggtctgaaagtttgctcaccacataggactccagaacactgctaagagggtctgaatgtccctcacattgtattccagaacactccttctgtggtctgaatgtttgttcctcacataggattcgagaacactcctgctgtggtctgaatgtttgtcccttacctaggattcgagaacattcacactgggatgtaaatgcttgcccttaacataggatttcagaacactgctcctggggtctgaaagtttgtccctcacataggattccagaactctcctgctgtggtctgaaagtttgtaccgtacataggattccagaacactgctgctgtggtcggaatgtttttctgtcacataggattccagaacactgcagctgggttctgaatgtttgtccctcacataggatttcagaactctgctacgagggtctgattgttggtccctcacataggattcctgaacactgctgctgggctctgaatgtttgtccctcacattggattgcagaacactactgctatggtctgaacgtttttctgtcacataggattccagaacgatcctgctgtggtctgaatgtttgtctgtcacataggattccagaacactgcggctggggtctgaatgtccctgacataggattccagaacattgctatgagagtctgaatggttgtctttcacatagcattccagaacactgctacgagggtctgaatgttggtccctcacacaggattccagaaccctcctgctgaggtctgaatatttgtccctcacataggattccagaacactcctgctgtggtctgaatggttgtccctcacaaaggattccagaacactcctgctgtgatctgaatggttgtccctcacataagattccggaacacttctgctgtggtacgaatgtttgtgtctcacgtaggattccagaacactgctacgagggtctcaatgtttgtccctcacataagattccagaacactgctgctggggtctgaatgcttgtccctcacatacgattacagaacagtgttgctggggtgtgaatgtttgtccctcacatggtattccagaccactgctgctggggtctcaatgtctgtccctcaaaaaaggattccagaacactgttacgagggtctgaatttttgttcctcacttaagactgcagaacactgcttcgagggtctaaatgtctgtccttcacataggattccagaacactgctacgagggtgtgaatgtttgtccttcacatagcatttcagaactgccatggtctgaatggttgtccctcacatagtattccagaaaactgctatgagggtctgaatgtttgtacctcacataggattccagaacactgctatgagggtctgaatgtttgtacctcacataggattccagaacactgctatgagtgtttgaaagtttgtccctcacataggattccagaagactgctgctggggtctgaatgtctgtccctcacatcggattccagaaccctgctgctggggtttgaatgtctgtccctcacatagaattccagaagactgctgggagggtctgaatgtttgtccctcacatacgattccagaacactgctacgaggttctgaatgtttttccctcacataggattccagaacactgctacgagggtctgaatgtttgtcctttacataggattccagaacactccttctggggtctgaatgtttgtccctcacataggattccagagcactcctgctgtggtctcaatgtttttttaatcacataggattccagaacacttctacaagggtctgaatgtttgtccctcacataggattccagaatactcctgctatggtcttaatgcttgtccctcacataggattccagaacattcatgttggggtctgaatgtttgcccttataggatttcagaacagtgttcctggggtctgaatgtttgtccttcatataggatttaagaacactcctgctttggtctgaaagtttgtccctcacataggattccagaactctcctgctgtggtctgaaagtttgtccttcacgtaggattccagaacactgctgctgtggtttgaatgtttgtccctcacataagattccagaacactgctaggagggtctgaatgtttgtccctcacataggattcctgaacagtgctacgagggtctgaatgtttgtccctcacataggattccagaacacttctgctggtgtctgaatgtttgtacctcacataggattccagaacactgctgctggggtctgaacgtctgtccctcacataggattctagaacactgctgttggggtttgaatgtctgtccctcacatagaattccagaacactgctgcgagtgtctgaatgtttgtcccgcagatgggattctagaacactgctgcgagggtctaaatgtctgtccctgacataacatcccagcacactgctacaaggttttgaaatgtttgtccctcacataggattacagagcactcctgctgtggtctgaatgtttttccctcacataggattccagaacactcctgctgtggtctgaatgtttgcccctcacataggattccagaacattcctgctgtggtctgattgttcctcatataggattccagaacactgctacaaggttctgaatttttgcccctcacataagattgcagaacactgctacaagggtttgaaagttttcccctcacataggattccacaacactactgctggggtctgaatgtttgtccctcacataggattcccgagcactcctgttgtggtctgaatgtttttccctcacataggattcctgaagactgctgctgtcactatagtcgttgcgagtgtctgaatgtttgaccttcaccaaacactaaatattctgcccctttagtcttggactttccagcctccagatctgtgagcaataatctctgttgtttatgaattactcagtctaaagtattttgttatagtagcctaaagagattaagagagcatcacctgccctgtcacctcatcaccgcattactaaagctatactaacagcagtcacctttagtgagtgcttcatgcatgagaataaagggaaaaaattgcaaggcatactaaaatacaaaaaaagaaaaaaatacaatttgtgtcaacagagcaagcttcagaagcagacaaagatatgattttggaattttttttaaacctctggagaatatgctaagggtctaatgaatgaagtagacagcattcaagtgtagatgggtaatgtaatcagaaagacagacatcgtaagaaccttcaacataatgtagtggtaaaaaatgtggtaaataactgaagaatacctctgatggcttattagtagactggactcagctgagtaaagaatctctgagcttgaggatttatcatcagaaacttcaaaaactaaagaaaagaaacactgaaaagaacagaagatgatatccaagactgtgggacaactacaaaaggtgcaacagagtaatgagaataccaggaggagaaaaaatagaagaaagttctgcaacaaccatgtctgagaacttccagtattaatgtcagacaccaaaccaaagatccaggaagctcagagaccaccaggcagaataaatgccaacaacctacacttggacatataattttcaaactatatgaaataaaagataaaggaaaactctgaaagaaaccagaggtggggcagaaaacaccttacctacagagacacaaagataagaactgcattcaacattgcagaaactgtgaaagcaagaagacagtgaaatgaaaaattcaaaatgttgacagaaaaaaacccaccaacctaagtttctgtacccactgaaaccacccttcaaaagtgaaggagaattaaggccttcctcagaaaaatacaaattcaagaaacttgttgccaggagacctgtcttgcaagaaatgttaaatgaaattctttagagggaaacaaaagatatataactgaaacctggatcaacatttttttaaaaagagcattaaagaattgtggtacaataaaaacctatgtatttattcttaattgatctgaccaagaagttcatagacaataacaaatacacacagatagattatgtatgcttatacacaattgaaatgagtgacactaatacaaggaatggaatggaaggatgggagggaggaattgtggtacaataaaaacatgtatttattcataattgatctgaccaataagtttgtagataataataaatacacacagatagattatgtgtgcttatacacaagtgaaataaggaacaataatacaaggaatggaatggaaggatgggagggaggaatcaggtgttttctttgttaagcaggtagtcacccatgaagtgggatagtgttatctgaaagtggacttgaattggttgtaaatgtatattgaggaattaggtgtgttctttgttaagcaggtagtcttatttgtgggatagtgggatagtgttatttgaaagtggacttgaatttgttgtaaatgttactgaggaattaggtgttttgttaagcaggtagtcttattcgtgggatagtgggatagtgttatttgaaagtggacttgaattggttgtaaatgtatattgcaaattctgtggcaactacttaaaaaaaagttttaaaaagagaaggacatgctaagaaagacagggaaaatgtagtcatctaaaatcatcaatgaaaactgcaaaaggcagaaaaagagtggtagacaaaagaatggagactgaggagaatgaatagaaaacagtaacaaatatagtagatattaatccaatgatatcaataatcactttgaatgctaatggtatgaatgtaccaattcaaagatagagattgtcagagtctatcaaaacacagacacatcttgtttcactgcactttgctttattgtgttttgtgaccatgtgttttacatattgaaggtttgtggccaccctgcaataagcaggtctgactggcaccattgttcctacagcacgtgctcacttcacgtctctgtgtcacatttcggtcattctcacagtattttaagctttttattattgaatctgttatagtgatctgtaatcagtgatctttaatgctactgttgtcattgttttgggaaccacaaatcacaccaggataagacagcaaacaattgacaaatacgtttgttctgactgccccaccaatgggccatttctctttctctctctttttctcaggcttcttttaattaatattaaaatttggccaattaataaccctacaatagcctctgtatgttcaagtgaaagaagagttgcatgtctgtcactttaaaccaaaaggaagaaataattaagcttagtgattaaggcatgctgtaagcaagacaggccagtagctagacctcatgcaacaaacacttagccaagttgtgaatgcaaaggaagtgttctggaaagaaatttaaagtactactccagtgaatacatgaatgataaaaagctaaacaatcttgctgctgttatggagaaagtttaattggtctagatagaagataaaaaaacaaaaaaaaattccattaagcctaagcctaactctctttttactttttttctttgtttttgagacagagattcattcttcttgcccaagctggagtacaatggcgtgatcttggctcatcgcaacctctgcctcccaagttcaagccattctcctgcctcagcatcccgagtagctgggattacaggcatgcaccaccacgcctggctaattttttgtatttttagtagagacggggtttctccacgttggtcagactggtgtcgaactcctgacctcaggtgatctgcccgcctcggcctcccaaagtgctaggattacaggtgtgacagccacagcacccggcctcccttcaattctatgaagacttagagaggtgaggcagctgcagaagaaaagtctgaagctagaagagcttgtttcttgaggtttaaggaaaaaagtcatctccataacataaaagcgcaagataaagcagcaagtactgatggaaaagctgcagaaagctatctagaagataattgattaagatggctacactaaacagatttgcagtggagacaaaacagccttctactagaaggagatgccatccaggatgttcccagctagagaggagttgatgcctggatttaaggcttcaaaggacatgctgactcttttgttaaggcctaatacagttggtgatgttaacttgaaaccaatgatgatttactattctgaaaatccaagggccctgaagaattacgataaaacacagctctgcctgtactctacaaatgggaagaaagcctggatgacagactatcggtttacaaatatggtttattgaatatcttaagcccactgtcgacaactactgctcaagaaataagattcctttcaaagtattaccactcactgacaatgcccctggtactcaagggcttttacagagatgtataaagagctgaatattgttttcatgcctactaacccaacattcattctggtgcccttggatcaaagaataatttcaaatttcaagtcttatcacttaaaaaatatatttcataaagctatagcttctctagaaagtgattcctttgatggatctgggcaaaataattgaaaacctactggaaaggattcaccattctagatgccattgagaacattcatgatttaaaaaaaagaagatcaaaatagcaacattaggagaagttggggctgggcttggtggctcacgcctgtaatcccagcactttgggaggccaaggcacgtggatcatgaggtcaggaatttgagaccagcctggccaacatagtgaaatcctgtctatactataaacaacaaaaaaattagctgggcctggtcgggggtgactgtaatcccaaacacttgggaggctgaggcaggagaattgtttgaacacgggaggtggaggttgcagtgagctgagatcgcatcactgcactccagcccaggcaagacttcatctcaaaaaaataaaagagagagagagagaagttgggaagattattccaaccctcactgatgacacaggggttcacgacttctgtggaggaagtaactgcagatatggtggaaataacaagagcactagaatcagagacagagcctgaagatctggcgagactgcagcagcctgtggagaaaacgtgagaggatgagttgcttccacggatgagcaaagaaagtggtttcttgagatgaaatctactcgtggtgaagacagtgtaaacaatgttgagatgacaacagatttaaaataaacttggtacagcagaaggaaggcttgacaggattgagcccaatgatttacgataatacataaacttagttggtacagcagtatgaaggtttgacagcattgaattcaattttgaaagttctactgtgggtaaaaagctatcatcgtatgctacagttaattcttttgtgaaagggagagtcacttgacacagcaaacttcaacgttgtcttattttaagaaattgccacagccaccccaacgctcagcaaccaccaccttacattaacgtaagaccctccatcagtaagaagactgaaacttggccaggtgcagtggctcacacctgtcatcccaacaccttgggaggccaaggtgggtggattgcttgagcccaggacgtcaaggcaacatagcaaaaccccatctctacaaagaaaaaaatacaaaaattagctggacacggtggcatgcacctgtagtcccagctagtcaggagtctgaggtgggggtttgattgagcatgaggttgaggttgcaattactccagcctgagccacagagtaaaaccctgtcacacacacacaaaaagattgcagctttctgaaggctcagatgactgttagcacttgttaacaataaagtatttgtaaattaaagtgtgcatactttgtagacatatgttattgcacactttatacagcacagtataaacatacttttacatgcactgggaaaccaaaagaaattgtataacactttattgcagtggtctggaaccaaacccacatatatctctgatgcatggccgtcctgtattgtacacttaaaaaaatacttaagagggtatatcttaggtgaaatggtcatctcatttttttttttttttttttgagacggagtcatactctgttgcccaggctggagtgcagtggcacgatctcggctcactgcaagctctgcctcccgagttcacaccattatcctgcctcagtctcctgagtagctgggactacaggtgcccgccatcacgcctggctaattttctgtatttttagtagaaacggggtttcactgagttagccaggatgatcttgatctcctgacctcgtgatccacctgccttggcctcccaaagtgctgggattacaggcgtgagccaccactcccggtctcattttttaaaaagggtgagaatgagaaatatatggggggtgatggtcaagtttacggtattatttgttgtgatgagtcctgaggcgaatatttatctctatactcattaagatgtatatattcggtgtcacacgcctgtaatcccagcactttgggaggccgaggcaggtggatcatctgaggtcaggcgttcgagcccagcctggccaacatggtgaaactctgtctctactaaaaaaatacaaaaattagccgggcgtgggggcgcacgcctgtgatcccagctactcaggaggctgaggcaggagaattgcttgaacctgggaggcggaggtggcagttagctgagatcgtgtcactgcactccagcctgggcaacatgagtaaaacctccataacacacacacacacacacacacacacacaaggtatatattaaatatgtgtaatttttgtatgtcaaccacaccttagttttactttattttatttttttgagacagagtctcactctgtcacccaggctggagtccagtggtgcaatcttggctcactgcaagctccacctcccaggttcacaccattctcctgcctcaaactccagaggagctggaactacaggcacctgccaccacgcccggctaattttttgtatttttagtagagatggcgtttcacagtgttagcccggatggtcttgatctcctgacgtgatctgcctgcctcagcttcccaaagtgctgcgattacaggtgtgagccaccgtgccagacaatttttatttttttgagacagagcctcactctgtcacccaggctggagtgcagtggcactatcttggctcactgcaacctcgcctcccatgttcaagcaattctcctgactcagtctcccgagtagctgggactacagatgcatgctatcaagcctggctaattttttgatttttaatagagatgaagtttcaccatgttggccaggctggtctcaaactcctgacctcatgtgatctgcccacctcagcctcccaaagtgctgggattacaggtgtaagccactgcacctggcaatttttaaatatatataattaaaaattaataaaaaacaggtatttgcaagtttccattttgttatatgcttattattctttatctttatgtcaggttgctgtgtcaatacacttaggagatcatagtttctaaattgaaatacaaataaatatgtctgaaattttttcttttttctttttttttgagacggactctcattctgtcacccaggctggagtgcagtggtgcaatctcagctcactgcaacatccacctcccagattcaagtgattctcctgcctcagcctccagagtagctgggattacaggcacccgccatgacacccagctaacttttatatatttttttctatttttagtaaagacagggtttcaccatgttggccagggtggtctccaactcctgacctcagatgatcctcccgcctcgacctcctcaagtgctgggattacaggtgtgagccactgtgcctggcctggaatttttttctaaaatttacatttctgagttaagaatgcttaaaatattattaaaacagaagcacaattcattatgtgtttcattaattacctttattaaaaacaacacaattatattacaataggacaaaaaatgtttaagcaaatgaaaacgaaaccatgacatacccaaactcaggaggaggcaacaaaggcagtgctaaagggaagcttacagctgcagatgcttaaattaaaaagaagaaagatctcaaacccatgctaaagggaagcttacagctgcagatgcttaaattaaaaagaagaaatatctcaaacccttgctaaagggaagcttatagctgcaggtgcttaaattaaaaagaagaaagatctcaaatcaataacctaacattacacctgaaggggggaaaaaaaaactaatgacaaaccaagcaaaaggaagaaaataacagattagagcagagataagcagaataagaccagaaaaaaaaggaaaaaaaacaatgagtttgtttttttaaagatcaataaaaattttaaaactcacagctatattaagaaaaaagagaaatctcaaatactaaaatcatgaataaaataggtgacagtacaacagatgccacagaaatgaaaaagattacaagagactaatgtgagcaaccatatgccacaaaactgggcaacctagaataaatttataaattcctagaaacacaaaccaccatactgcatcacggagaaataaaaaatccaaagagacttgtaactagtaagaagattcaaccagtaatcaaaaaccccaccaaaaagaaaattccaggtccagataacttcactggaaaattttaccaaacatttcaagaagaattaatgccaatcctctgcaaaatattccaaaaatgttcaaaaaccagaagggaacattccaatccattctatcaggtcaacatttatctggttccagagccagatgaacaccttttgtaataaaaacactcaaagaattagtaatatatggaaactcctcagtaaataaagattatacatgaaaagctcacagctaacatcatactcaatggtgaaagactaaaatcttttcctctaggatcaggaataagatagcaacatctcttcctgccacgtctattcatcacagtactggaatttctactcagaataatgagtcaagagaaagtaataaaaaggatgcaaattggaaaagaaaaagtacaaaattttgttcacagacaacaggatgtaatgggtaaaaatcctgaaattcccaaaatattggtaaaataatgaaattcaacaaagtttcaggatacagtaacacacacaagtcagttgcatttccataaactaacaatgaacaatctgcaaataaaattttaaaaagagaggccaggtgcagtggctcacacttataatctcagcactttgggaggccaaggcgggtagaccacctgaggtcaggagttcgtgaccagctgggccaaacccatctctaaaataaatagtaaaactctgtctctattaaaaatacaaaaattagctggacgtagtggcagacacctgtagtcccagctacatgggaggctgaagcaggagaattgcttgaacttggaaggtggaggttgcagtcagctgagattgtgccactgcgctccagcttaggaaactgagacgccatctcaaagaaaagaaagaaaggaaagaaagagagagaaagaaaaaaaagaaagataaaacaaaagaaaagaaatttttaaaaagaatgacatttggccgggtgcagtggttcatgcctgcaatcccagcagtttgggaggctgaggcgggcagatcacctgaggtcacaagttcaagacttaccttgtcaacatggagaaaccctgtctcaactaaaaataccaaaaaattagctgggcgtgctggcgcgcacctgtgatcccaggtacttgagaggctgcggttggagaatcgcttgaataaagaaggcgcaggttgcagtgagctgagatagtgccactgcactccagcctgggagacagagcaagactccatctcaaaaaaaaaaaaaagtattacatttacaacagcattataaaaattaaaaataagcttaaccaaaagggcaaaagatttgaacacagaaaactataaaacactgttgaaagaaattaaacacaaataaatgaaaagaaaaggtgggtttgcagattagatgatttcatcttggaatgatgtcaacactactcgaagtgacctaggttcaatacaatccttataaagattccaatgacatttttgataaacagaaaaacctatcctaaaattcatatggaatctccagggcccatgaataggcaaatcaatcttgaagcagaacaaaattaaaggtctcaaaacaattacaaaactgcaataagccaaaaaaaaagtggtcatggcgtaaagacatacttgacacacttatggaccaacacaacagagacctcagaaaccaaccctggcatatatggtctgatgatcttccacaaggatgccaagaccactcaatggcgaaggacagtttcttcaacaaatggtgttgggaaaattgtatatctacatgcaaaataatgaagttggactcttaccttacaccacgttaaaattaattcaaagtgaattataaacccaaaagtaaaactagaactatcaaactcctagggaaaacaaatttggaaaatgctttatgatgatgaatttgtcaataatttttaggatatgacattaaaagctcaggcagtaaaagcaaaaatatatcaaacctaaaaacttctgtaccacaaaggtcacaaccaacagggtaaaaggcaaactgtagaataaaagaaaataccagttgagtgtcccttatttgaaatgcttgggatgtgtttcagattttgtaatatttgcattattcttactggttgagcatctcgaattcaaacacctgagtctgcgatgctccaataagcatttcctttgagtgtcatgttggcactcaaaaagtttcagactttggagcatttgggatttcagatttttggatcagagacattcaacctatagttgcacatcatgtatctcataagaagtgaacattcagaatacgtaaagtactcctacagagagactaccagaagcagagaggagcaaacacattttcacactagagcacctcctatctctcccggattccaattagggcagagtaagtgctagttatctgccaacccaggattaggccctgcagctgcagtgaaaataatcacagaagaaaactaagaaataaaaaatggagaaagtgagacatcaaactaaaattactagaaacccccaggaagaaggaaaaagaaaccaagaaaacagaaaaacaattaaaccagttaattaaaccttggcatgaccagaagatcagagtttcctaaaggagtggaaatttattgatttgaagaggatttattgattactgatttgaagaggaagaaaaaccatgaatggtctgaagcaaaagcctagtgtctgaagaagtcagtagggtgaaaacaagagctggccagaatatccacagatggtgacaagttggcaaagcctttactagactactcgtgaggctaactagaggccaaggagccaacactgctcctgtccttacagagagaccctacacaggattcccagatatacatggaaggacaacatcttatcaggtcctctctgtgcagatgtggttatcattccaaataatgagctccagccccaagactgttccatcctcaattgctttgagtgggcaatgtaggctctccacacacgagctacgtgtaggttccttgggtacccagatgggagccatgaaacacaaaccctccatggtcaggtctgtatttgtttcctgcctttttcccagcaatccccaggccccagcagtggtggtctacctctgctgattctcattcagaatctaaacttagaaacaattataacctagaccccaattctacctgaaagtaacagaataacataatctataccctgcagcatgactgtttgcccaacgtaatgaggatgaactgagagataatgaaccatcatgaccctggcccaagtaatgagaatgaactgtgagataaatgaatgatcatgacaaaaaccccgctacaacccaacaacaaaataaaatgattaaaaaatggacaaacaacatttatccaaagatgcaaagatgatatacaaatagccaacagatacatgagatatatgagaagatgtgtaacatcactagtcattagagaaatgcaaaaagaaaccacaatgggacatcacttcaaacccaacagaaagtaacaagcgcaggtgaaactgtaacccttgaacactgttggtggaaatatgaactggctcctcaaaaaaaataaaataaaatgaccatatgatccagccatccaactattacagagacagaataactagtagcaggacctcaaacagatatgtgcacacctaagttcacagcagcattacacagccacaaggtggaagaaaccaaaacgtccgtccagaaataggtggataaacaaaagcatatatatatacatgatatatatatatatattatatatgtaatatatatataatatatatatgaagaaatattattcagccatagaaaggaagaaaatcgtgacacatctgacacataacatggaacctacttacaaaacaacaaatattatataaccctaggtatataagccaaatttttagaaacacaaagtagaatagtacttgccaggaggtggaaggagggggaaattaatagttgttgaatgggtatagaattttccaagataaaaaaaaaatctagaaatctgctacacagcaccgtaaatattcttaactctacaaaactgtatacctacaactggttacgatggtaaattttaaggtatgtgtttgttacgaaaattctaaataataaattatttataaaaaatgatcttttttgacacagggtcttactctgttgccctggcaggagtgcaatggcatgatcacagctcattgcagcctcaacctcccaggctcaagcaaccctcccatctcagcctcccgaatagttgggactacaggtgcacaccaagatgtcaggctaaattttggtttggtttttttgtagagagggttttgccatgatgcccaggctggtctcaacctcctgggctcaagcaatccacctcccttggcctcccacagagctgagattacgagcataagccaccatgcccagcctataaaaaattatttcaaaaagccaaaatattaatcaaactggaatatttagaaatatttaacccaaaagaagttaggaaagaatatatagaagatcaaaacacagacgaaggccagacatggtggctcatgcctgtcatccaaacactttgggaggccaaggtgggtagattgcttgagctcaggagttcaagaccagcctgtgcaacatggcaaaaccctatctctacaaaaaatataaaaattagccaggtgtgtttccatgtgcctgtagtcccagctactcagtgggctccagtgaggattggttgggcctgggaggcagaggttgcagtgagccaacattgcaccattgcactacagtctcagtgacagagcaagaccctgtcttaaaaaaaaaaaaaaaaaaacaaatagaaaataagtagaaaaatggcagacctaaatccaaccttagcaatgattagttacaatgtaactggacaaatactctacttaagacagagactgccagacctgagaggaaagcaagacccaacaatatggcatccacagagacacaatttaaatacaaagacacaaagtatgagaaaaaatatgctatgcagacactaatcataaaaatatgctatccagacactaatcataaaaagcttcaacagagacgttaacactagatgaaagaggctccagaacaaaatatatcaccagaaataaaaaaggtaatttcataaaaataaaagaatcagagagggtgatgttacaattataaattgtgcctcaaagtgcacacaaagtactctcacacacagagcctcaaattatgtgaatcaaaaacaacagaacaaaagcaggaaattgacaatccaaaattatagctggtgaattaatactgctctctcagtaactgacggaacaaccagataaaaatataggaaaaatacggatctaaatgacaaaatcctgacccaaatggtacttggcagtaccaagatagactgtatgttgatcaattgagaaaatgttcaagcatgacatagtatacaaagtatgttgtctgaacacctgaaattaaattagaaaccaacaacaaattgatatccagaaaagcctcaaatgtctgaaaaccaagtaataaactttgaaataccctgtgagtcaaaaaagtattcacaaggggaactggaatgtatttggaacaaacttgttataaaaatcatatttctggtagactaaaggtgacaacttctttcctgctcctctctctgtgagaaccaattccccttaaaccttgcccagactactaacttgcttggccaacagaaggtgacaaaggtggtatttggggacttcagaagccaggctgagaaaacagaacacttatccaggagaaagccagtcaccaggcaggaaatcccactcccctgagacctcatgatggaaaccacatggccagtccgtgactagctacacacattgacatcccccactgaccctccagcaacaccgactcccaaccactagtgagccttcagcaacatccactcccaaccactagtgagccaccctgcacaccaccccactgtgctttcacacaatccagcttggctgcaactgtgtgtgagatgagctggccaccaagactctctaagccaaaaaacaggtaataatgagttgttttaagctgccaagttttggggatggtttcttcagaatagataactggaacagaatatggtagctggaaatgagccgctgtggtaatcagaagctacaatatgtgccacgactgtgaggctgacctgtaactgggcctcaaggagaccattcatgcaacctggaagggcatcaagactcttggtcagtgcctgaaggacggtgagaaaatgtcattggaaagtggggaaaaggcctgagagttatgtgctgagggactgtgagaaaactacagccacaacatggaaaccgaaagggcactgcaccatctcagggatctgcctaaggagacatctgggaagaacatggaaagtgctaccagcctaccctaactgtcattgaataaatatgacaggagagggacatgatctaaagaaggaagttcacttttcaaacaaaatttagagaaaatataaagaaataatttcttgtctcaaaaggccaaagaaaaaaaaaaagaaaaggaaaaaaattaaaaagaagccattgaataccctattgaccataagaaaaaggcagagaaagttggtcaacggcaacccaggcactgaaggaaaaagaacatggagaatgacaaaagcccagaggcaggagtaaaaggacacaaacgccgttctcagggacaaggactgggcgccattctcagggacccgtactgggcactaatcacagaactgtaacaggcgccccatgggaatgaccagctgttagacggggcctgcagggcagcacctccctcctgcctcccaccaacagcttctaaagggaaatgctgactgttttcacaccagtcccctcactgcggctgagtgtgtgggcacagatgataggtcacaacaacctgattcagtccccactgtggctgtgtgtgggggggcagatgacaggccaccataacttgattcagtcctcactgcggctgagtgtgtgtgggtgcagatgacaggccaccacaacctgattcaggattcagttgggctaccagccagtgccataaggaaaaccattctgggactcttgagaggggcaaagcataatttgcatgtgggagaaacgttaatagtttgtggccagaggacaaactgtggtttattaaagactgctgcaggttcctactattcttctcatcaagaggtggaatctaatcaccttccccccttgaatcatggctggtctcagtgatgagtatgactggacagtgtggcaggatagatgctctgggacttctgagggatgatcatgagaggccttacagcttctgcctgggcctcttggacacacaccctgggagaagccagacaaacctgagtaactgacactgccagactgggaggaagtccgtgctggccacaaagagagggctcggtgcctgctccatgtccccagccactagagtccttctgggtgcctgcttcatgtccccagccactagagtcctcccagatgagaccagggacatcacgaagcagccaacccacactgccctgtccagtgtcttgacccagaaaattgtgacatgtaaaaagaataaattcctggtttaagccagtaaggttactggtacattgttacattgcagataattaaaaccttgaaaaactcatgagagatcccaagtaaaaccttgatctgaaacatggcatgtggtgatttatattgagtattaggttaaaaatgcaagaatggagcatagttaatattttacgttaaagctaaaactataattgcccacttaaaattttcagttaattaggttgtcactttttgttcttaaccaagatatcaactagttttagtacataaacagttggaactgatgcacacatccgtttttccttactcattttaagcagctatctgaaataggaagcgtaatataatctttaaagaatctgaaaatatgacagaaatgtttaaactataaacatatattgtaaatgttagcatattatatacattgcatattaacataagctaaaatcattgacataaatttatataaacaaaaggtagaaaatatgacaatgttcttcttgttttttgtctttgcatatttctttattggcccttgtcaaatgtgacccactaactcctgaatgctttctctctccccatggattcctaaggatgtcaccacagtgctggccagatgcacaggtcacaggtgactgaacctcatcaccccacaaacacacccttcaggttttgccaagaatgacactgtaaatataacaaagcttctgtgcttgttagtgaacaccaactcagcttctctcctgtattcggaaatcaggatgagatgaaaacaacaagcaggccaggcacggtggctcacgtctgtaatcccagcactttgggaggccgaggtgggcggatcacctgaggtcgggagttcgagaccaccctgatcaaaacagagaaaccccatctctactaaacatacaaaattagccgggcatggtggcacatgcctgtaataccagctactcaggagctgaggcaggagaattgcttgaacccaggaggtggaggctgcagtgagctgagatcacaccactgcgctctagcctgggcaacaagagcgaaactctgtctcaaaagaaaaaaaataaaaataaaagaacaaggaaacaaaagtaacaaggcttgacaccagatgagcctgaatctaagcaagaaaagcccagaagaaatcccattttgggtcactggctgcacggtagtaatgccatacacataagggaagagaagaggatgtggctttcacttcgaattttttgagcttaaggtaaatttggatagctacaaagaagcattcaacagagagttaaacctatgatggaaagactgaagaggtccaagctgtagagaaacaggactgcaaaccacaaagggctgaatcagtcaaggagaactgcagggcaagatgaacagggaccaatggaacatttggacaagctgttgagaagaaaggagaattcagagaaaaagaactgtcagtgaggtcataataggaactgttacagtgaactaaatatggcctgggaaggactctgtacttctagatttgagtccctgtggacaaactgcaacctaacttaataggtagaaagactgaaaacctaacttaggagtatgtgcctaaaacagtagctgagtcgtggccaatcccaacagccaaacttctgccactcacacactgctgagtgttcagctgtgttcaaataaggcaaatgctgagcactgtaaccagtccagttgtttctggacctcactgctgagaactgtaatggacccagttgcttctagacctcactcctcacttcagatttttgtacatcatgttccctttattgtctataaatcttccaccatgtgtctgtgctggagtctcaccaaatctgctgtgattctgggggctgcctgattcgtgaatcattcattgctcaattaagttcctttaaatttaattcagctgaagattttcttttaatagatggtgtcagaagtgggatctgtgggagcaggactgctagggcctctggagctatactgtggtgagcagtgttgctaaggcttctaatgacccccagagtgctgaggtacaaggaaggaacctgaaaggacccgtttgtgatggcagcagtggcccacgtggagcagttgctatggagacactggctgcagtggggaggagtggctggggctgtgcactcctcaaagctggtgggagccaggaatgggtgggagacctgtcccttctaaattatcaggcaggaaccccgccctcccaggcacagctgcagccatccagccatgactgcaaacccgggcatctctgcactctcagaggcccagcaagcccccctgccccgcaggctcagttgtacctggtcctgccacctggcgtccctctgcttccagaacccactccaaattcggatccaagttgaggccaaacccgggcacagtcacaacacggcccggtttgtgcaagctcagggcagtgctgacatgccagccccctgccaccttggccccctccagactttgggcactggcaagcacaggagggagggtgaggtggggctaagagtggctcagcagtggccagaaggccctcctcagctcgaacgcctgggcactatgggcacagctacccaccgtgcatctcctctcagctgctgagagctgaacagacgttgggatgacctgcctgcagaaaggaactacccactgcaggtctcctctgagctgtactgtggctcaataaagcacctcttcaccttgctcaccttctacttgtccacatacctcatttttcctggactcaggacaagaactcgggacctgccaactagcagggctgaaagaggtgtaacataaacagggctgaaacgcgctccttgcttgccaaattgcaggcaagaagaagagaagagagaaggagagaagagctgtgtcccttcagggaacacagacctaggagctcccccagccagggctgtgacaccttctttggggctttgcaggtcctgcatctccaagcttctgggtgccactgcattccctgatacccacagtggaagctgtttgcagtcggcctggtccagctgcagcctcacagggagctggcatctgtgcctggagctgcccaccccactgcagctggcatgcttggctgtgtgcagtggccagatcccatgctcgcttgctcacacacccctcactgctctgtacccagctcgcccttggcaggtgtgggatccagaccactagcatgagctgagtggacagaactaacccagtgggcccaagcaaaacacaggtaaaggctccaccagccagaggtttcaggcagaaaagtgacgcctcagattctgtaacacttgtgtcctttgatctctcggagcagctggggatcatggtaaattttctctcggatttcagagctccatggatttgtgttttgagctctgagtttctttgagcaaatttctgttccaaactgctatccagccatgactggctggatgttttagaagttatgacagaaaagggaccaggtccaggatcagatttgatccagtagttaactggcttgaatccagttccagttagaggcctcctacatctgactgggtcagaaggaaagtggtagtaaatgataatattggaaggttgtaacatttggcttttgaaaattcacagggatttttgtgttctacccctttgtttcatttttctcgcattcttaagcaggaaaaaaaaatcattggctaagttaatgaagggaacccgggagtaaagccaatatttttggtaaaaataggatccttaatttctggaaaactaagctccttctggctaatacattaggcctgggaagcagcaaagtcttacagaaatggcaaaatcttattaagataacttacagtggaacattccaaatgaataatgccctgaagtgcatttaaaaatgagggctcccaaattagtctcatctagggatgcctattaatatgcagaagcttctaaaaagatttagagatggcacggcccatctgggagcaagtttgagtcttaccagtttgatactgggtgctgagcaaagtggcacgtgtctatgttttgtcacatgtattttgctctgggcagaatgaaaaatgttaatttggttactccaagcaaccccttgggctgcatttggcaaagctgagtggattcttcctgcgattccatgattttccattgtgatgcagcttggcccccagagctataatgtggtgaggagggtgacagagcaagacgcaatctttaaaaaaaaaaaatggccaggtgcagtggctcgtgcttgtaatcccaacacttggggaggctgaggcaggtggatcacctgaggtaaggagttcagggccagcctgaccaacaaggaaaaaccccgtctctactaaaaacacaaaattagctgggcatggtggcccatgcctctaatcccagctactcaggaggctggggcaggagaatcgcttgaacaggggaggcagggggttgcagtgaaccgagatcacaccattgcactccagcctgggcaacaagagggaaaatccatctcaaaaaaaaaaaaaaaaaaaaaaagaaagaataataggtttgtctataaggttttatgaaaaagtgggtgacatttggctttctctctttaaagaagatgttcaggtaatattaaaaaataatgaaaaatttgtttgccttttaaataaactaccaaaaaaaaaaaaggaaaaacaagaggcagatcgtttgtgaagataagtcttccctctatcaatgagtaaagatttttgccctttaaaacttttttaagtcatgattttaagtaaatgaatgacttacggtgacctggaattctatttcataacatcaagtgtttaaacttttaatatatttaataggcttcccaaaatcaaatttcaacttcaaaattgtcttttctgacctctacctttgggatactacagaggcccttgaagcacccaaaagagaggtaaacaggactatttaacatgttaagtcacatgggtagcactgtcaaaataaaacataatgttgaaccttcttgaggttatatttagtttatgtcatcaaccctttctaaaattgtataggatttctaaaattcttttttttttcccccgagacggagtcttgctctgtcaccaaggctagagtacagtggcacaatctcggctcactgcaacctccgcctcctgggttcatgccattctcctgcttcagcctcccgagtagctgggactacaggcatccaccaccatgccaagctaatttttgtatttttagtagagatggggtttcactgtgttagccaggatgttctcatctcctgacctcgtgatccttccacttcggcctcccaaagtgctgggattacaggcgtgagccactgcaactggccaggattctaaaattctaatatgcctatatgctatctatcataattacctgttttgtttgttttgagacagagtttcgctcttgtcacctaggctggagtgcaatggtgtgatctaggctcactgaagcctccacctcctgggttcaagcatttctcctgcctcagcctcccaagtagctgggattacagacaactgccaccacatccggctaatttttttatttttagtagagacagggttttaccatgttggccaggctggtctcaaactcctgacctcaggtgatccacctaacttggcctctcaagagctgagattacaggaatgagccaccacatccaccctaattatggttattaagttattgtagaccacagaaataagcaaatttccttatcaattgtctttaactataactatttaaagtcatttccacagttaattgcttaatggtgatgcagtttctaaaagcttcacaagcatgcaaaattctagaatagaagattcatgaaagaatgaaaaggaacatgaaaaacactcgggaacacaggtttctaataactttaatatcataggtaaaaattccccataagttccccgatcccccaataattggactggttaagaattctcaaaagttaggctgggtgcagtggctcatgttggcaatcccagcactttgggaggctgaggccggtggatcacttgaggtcaggagtttgagaccagcctggccaatggtgaaaccccacctctactaaaactacaaaaattagccgggtgtggtggtatgcatctgtaatcccagctactcgggaggctgaggcaggagaatcacttgaacccaggaggcggaggttgcagtgagccaagattgtgccactgcactccaacctaggtaacagagtgagactctgtctcaaaaaaaaaaaaaaaaaaatcctaaagtttaataagaagaccaactggtttataaaactgctaacccaagtaaaacaaaaattgaatatcaaggaaatattttgccagatttgcatgctaaatcaccaatattgaaattgtttagatatataatttaaatacactccatggtctaagccaaattacctataactcatcagttaccagtgccatgcacctaatttgaagaaacagctggtagtcaagaggatgtaagtctaatgttaattaagcacggacttatgaagaaccaggatggccacctttccgtcttaagtccttaaaacttttgttattaaaagttctgcattccataactcatcatggaaagagaaaatgatccaaattaaatatattgctgtggtgatctctaaattgctaaaatagtttataatcaatgtttggtttgtcgaacctatattcctaggaaaacaatcaaaacttcaggtgcatttggttacctgatgggccatttaaacattttataaagggatttcattcagttgtcattttcagtgcatgttttctgattgtaaaaaagctcttccatgcaagagggttgatgttaaaacagtagattattatgctgaagtgtattttcaccagctaaagaaagccttttatggttcacagaggacagccaaccccttcacaatctagaatatgatgactggatcttctgagaacatcagaggactgcccttgccatccacatgacagcaaaactttaaaaccttaaactttgggttcatagtcttacaactctgaagggtccctccacactcggaaccatacaccccttggaacccttaaggtaaagctaacaaggacagttcccccccagaagaagatggcatccttaatgtgaacagcttttcccaagatcacagatcaagacttctctactatcatgagactattatcttaagtatctgtgcagctgctaacatggcatatggagaaaacatcgggtattataaagatttggttgtagggaattaacaaaaaaacccacttagttaagcaagtaaactctttatctaattcattctttaatctatttgattttaggtggtttgatttatggggacccggagtaaggagcatataccaaattcttggtgttatcccaatagtcataagagtctccctggtgcactgtacttactcaaatgttttaagagtttgcatgcagccatctctaaaatgtcaaatggtatctcttcatctggaatgacaacagattaaaaaaaatgtgcaaccataaggacaccgtaacctatgagtgacatgctaaaccagaaacccaaaacaatgggagtgacatgctaaaccagaaacccaaaacaatgggactgatgtactaaaaccggaacccaaaacaatgggagtgatgtactaaaaccagaacccaaaacaatgggagtgacgtgctaaaccagaaacccaaaacaatgggagtgacgtgctaaaaccattacccaaaacaatgggagtgatgtgctaaaccggaaacccaaaacaatggtaactaagagtgaggctaaggccctacattttggtcacactctcaactaagtgagaacttgactgaaaaggaggattttctttttctgagacagagtcttgctctgtcccccagagtggagtgcagtggcatgatctcggctcactgcaagctctgcctcccgggttcaggccattctcctgcctcagcctcctgagtagctgggactacaggcacccgccagcattcttggctatttttttgtgtatttagtagagatgaggtttcgccgtattagcaaggatggtctcaatctcctgatctcgtgatctgcccacctcggcctcccaaagtgctgggattacaggcatgagccaccgtgcccagccaaaaggaggaattttttaagcaaaattctgggaggccattgttttgaactaagctcatgcaataggtcccaacagaacaaaccaaaccaaaatggagtcactcatgctaaatggaacataatcaaactaagactttaaggaaacacataaatcctagaacaaaccaggttttgtttttctcctgtaaacaggatattccagcataagaagacaccttctactcaagtccttgttccaccttttcaaatctcactgttctatttcccagtgggtttctaaaccaaataagtacatttgcaagggtaatagtgacaccagtgactgaagttttggctaatctctcaaaattgagaaaataaccaaagggaaggcattgttaaagtgaactaagtatgtcctgagaaggactccataattatatatatgagtccttgtggatgacctgcaacctaccttaataggtaaacaagaatgaaaacctaacttgagtgtatgcacctcaaacaacagctacatcttggccaatcccaatggccaaacttcaaccaatcaggcactgccaaatgttcaaactgtgctcaaacaaggcaaacgctgagttgtttctgtacctcacttccgatttcgttatgccacttcccttttgtctacaaatcttcttccaccacatgactgtgctggagtctctgtgaatctgctgtgattctggggactttccgattcatgaatcgtttattgctcagttaaactcctttaaagtttttcttttaacagaactaacacggaagaatttccagatcatgaacagatgttttgtaatacccaacgttgtattaacatgaatagactcttccttagatagctaaccttgtttttaatatgaatagactctcccttagctgagaaaaccagacaaactccatttggctccttcatttacaagacatcaagggctccttacccaccccctttcctcaaggactttaacttgtgcaagctgattttcaacatatcaaagagtgcaattaactgataaagtgctgaggcaagtgatgtccgcagttcccagcaaattactcagagataatatcataaagcccccacatttgtctggaagataaagcccagagcaccctcactcatcactttgtggtgaatttaaagcctctgcacctggaacagtttgttttcctgtaaccatctgtctttttaagttttttgtctgttttttcttctgtaagtttattgcagctggaatcccccctcccctctctaaaccaatgtataaaagaaaatctagcccattctttagggccgagagtatttcctgtgttagccatctctcagtcaccagctaataaaggactcctgaattcgtctcaaagtgtggcatttctctctaactcgcttgggtacgacagtttcaactatggtagaagactcgagtaagacaaatacagcccccctaaatttgactattatttaggttaatggtgagtttagaagaaataagttaagactacacagagtgggctaaattgcaaataaacactgaaaatatttcccagaaaatatgactttgaacaggctgctgcacaccctgcatgtagagataaactaagaaaaatgtgtggagagttatttaaggacctgtggttaactcagtcctcaagatgttccgggtttcatccatgagtcaaggaggacctcccaaaagctgtttgggaccacactctttgagcaaggagcataccttatgatggaagctgtgctttagcagcagatgaccatttccactgcacaacacgccgtgctttagcagacgatgaccatttccactgtacaacatgctgtgctttagcgtcagatgaccatttccactgcacaacacgccatgctttagcggaagatgaccatttccactgcacaacacgtcatgccttagcggaagatgactgtttccactgcacaacactacaagtgcttactgccagaccggtgtgaaatatgttccagcacataatctatgtcaccaatgaaggtggtggttaagacttggtgcacacaagctttcctgtcccacaagaatacagcgtgctctcttttcgggttccattccaatcacgtaacaaacatgactgccttttttgtttcggcatcagaaagatcagaggaaactttgcactcaacttagacaactctaagcttttataacctgtctatatctacaggtcagctttatcttatttatgtatatttccttcaacctgagttttacttatttccacttttcctttttaattcacagacacccataaactcagaaaatacagtgtaaaacaaagtgaagaacaaataaacaactcaccagagatttattcgtttcttgttgctcttggaaacacccagaggacactggaaacatagctggaagagaaggcaaatgacgtcgattaaggagagaactggtgaggtgtggtcccagattcttctgcccaacactctagacacattacctggaaaagccctcctccctccggaaaaagaaaaacttccccatgggagaagagtccttcacacctcattagtggcagcaaagactcaagttaagataagatacatctacaagtacattaattggtagacattagatgcacaatttatttttgaataaaaatatgtattacctactaatttagtaacaatattacctaaagatataatctaataatttaatacaaagaaacattataagttcactaaaataaatgttatagaaatatactgggctgtattaaccattttcctattaatatgtggattccacaaataacttcatatgagtattcccatgacagtacatcttgcttttctatacctcaacatcatggaaagtgcatcttgcaacccagcaattttggcctacgttttttaaaatgtacataatatgtatttcctacagtacacgattctactcatgtttcccaataacacctttccctgtatccaagccctcatattatgctctgacaataaattgggcttttccatctgacttgtccagtgaatggacaatggaaaatgtgatgcaaatatccattggttcttgcctttttggacacagtcatattgtgaagaggtctggagctaccctgttggagacacagggcctagccaagagtcaccacaaaccaccagattgtgaaggaaactatcttaaaccaaccaggctcagtcaaggcaccaggtgactaaggcctgttttgtgatccaggcaacacaaatatatcaactacacagctgaacccaccacaccaaaatgcagatccacagaacttcaaacaaataaaatggtggttgttttttataagctagtaaggtttaattagttccttaaacagcaaatattaactgttacacctaagtgaatagaattcaatgtttttaacgaaattatgtagggggagaaagtcttaaattacaaatcaaatgcaatcaatagaacttcacaatctatgctatatttggtgatggactaggtttaatatatctcagacactggaaacaacaaggtaagtttgaaggaatgggactgtatttggagagtatttcaatcttttcaagtatgacaggtcactcctgcaccccagaccacactttcaggccccttcaaataaggaatatttcctaggtccttgcctgttcttctcagctgaattcacctcaaccttctgaaagttcttccaaaccttccactatcacctagtctttgcaaatcttgtgcattccagggagtagaattaatatttcctgagcgaggaaaactgggatcttcacctgcgaccttttatcctcctctgaagcaccagtgagaggttagaccacagggctgttctttcaagtgcgcttcttattcatagggaaccctccctttcaaactttataacacacagttaagactgaagtacccttaaggctgaagaccatcatccagtaccccatctccctggcggaatcagtgagttcctccatggaaactaggtctctataaacttccataaatgcaatccaggaggactaggcaggtcacacagtgaaggagggaaccagaaacttcacttgctaaatagacaccaggaaacccaactaatacaaacgcccagcttaagactagaggcacacgcatttcgcactactcctctgggaatggggaacgtctcccgagaactgtgtgttagcacggggacagatgggcaaactgagctacatgagggttggtaaccgggtccctcagcggcaggacaggagcgcggcctgcagactccgggcccagggccaccagcctcgcctacccactcctgtgcctctggaacccgcttcactgctgggaccccacgtctgtcctcccagcccccgccagggtccacggcccgcaaatgcacgtcaggcccctcctgcccgcgatgcgcccacgcgtctgcccccacaaatggggaacactggtctggccccccgggatcccccgaggcccacaggttcctcctcgccctcgcacctacccacagggacatagaaccaagccccaggcctgctcagctacacgaccaccgctgggatccgcacttccggaggaaaatggcgaagtgggcggggtggcacatgcgtagagagaacctggttcccaaggtccttgatggtaaacatcattggaaggtgacactacatttcctatgaggctctgcggtcccccgttaggaacgcacgccggacattctgttttgcccagcagtgagtccagttacctggagacccggacttaatggatcaggactggtccctacccacgtgacacagatgtggcattctggttcgttattaaatcctggattcacagcctgggacattgtgaaaataatggagaaattccaatagaaaccaattggtctatgctgttaatgagtaactttttttttttttgagatggagtctcgctctgtcacccaggctggagtgcaatggtgcgatcttggctcactgcaaactctgcctcccaggttcaagagattctcctgcctcaacctcctgagtatctgggattacaggcgggcgccaccacactcgcctaatttttgtatttttagtagaaacggggtttcaccatgttggtcaggctggtctctaactcctaacctcgtgatccgccctcctaggcctcccaaagtgctgggattacaggcgtgagccaccgcgcccagccctcaagtctattttttatagatgcattcgaaagcatgaaaaaaatcatgtctctattttactttaaatttttaaaaacacaactaatgaatatggtaattctcttccaatctgttatcttttctctcacgaagctaatttgtgagctttcaatttacacagttagaaaaaattgctctagtgtatatactaggataaaataacagggtcataagacaagtgcactccataatctttgtgacaacttacacttccagtgtctgatgaacatttgcccataaactcccacgtttcatccatccatccatcagtcaaatctacctatctttatttatttattgtgcgaaatacctgaactttgcctttccttccctgatttctgccacaaactaggcaaggagttctgcctaggggtttttcagagctccggctaccaccgaggttcctaacagggaaattgccagcttgaatgcttggggttgatgtgggagtgcgtgtgaaacgggtgtggggtgaaagggcagtgaactttgtaggtgggtagatgggggtgtgaagggctttcaggtaagaggcacagaggaaactgggagaggcagcgaaagcacttcacgcctcagataaccagaagatgctcccaccagcgccatgacagtttgccagtgccatggcaacacaggaagtccccaccccttgccatggaaacagctggaagttactgcccatttctagctatttctgagtaacccgccccttaattagcatgtcattaaaagtgaattataaaaatgactacaagccacccttaggctgctactctgggagcacaacccacagagggctccctgccctgcaggagcggacgcagggctgtaacaccgccaatgcctccatagagctgctttattccaccacaggcttgcttttggattccttcctgagcgacgccaagaacctgcccttcctcagtgtgactcttgcctaaaatctatccctggttttctcttttcctaagcatgccctgacttgttctttcatctcctctgaacttgcaattgctcctcagtgactctattctgcagatccagaaaactcaaccttaatcttcccagagccctgttgtctccaatattggaatctctagccttgctttctcagacacctagattacagtcctctctcttgaacacctattggtaaggtatccggggatcctttaaatacacgatgattggcagggtttacataggggaaatcagtgcctgacaattcgccttccaggatatggattgtcattccctctctttgtgggccccagtctcctatacataaaagtagagattgtaatactcatttgacttgcagatacctcaccccgaacccacctactataacgtaaaagccaagaatgcaaaccctttcctcaccccgtgaaggtaaagtcctcagagccaaggagagaaggctcagggatggtacctgggtgtttccaacactaaccatgcattgtagtttttagtgttcaagtttaagcttcttatgttaaagttaccccagctttaattatattgtaacaagatttatttttgtaatcccatttttggattcttgatttcttggtaaagaaatacagttatttttgtataccaatcttatatagtgttacattccaaaatttgttcatgagtcctaacactttttagtaaatttcttatgattttctaaatgcaagatcatgtcatctgtacataaagataactgtacttcttcctttccaatctagatgccgtttatttatttacattgccaagttgtcccagctaccactgttatcaagtaaaagggtctcactgcccaaagctctagaagccagtaacatgacactgagtttttgagaagagaaaaactttaaagtcaaaccaaaacctatgggatacaggccaggcgcagtggctcatgcctgtaatcccagcactttgggaggccgagttgggtggatcacaaggtcaggagatggagaccatcctggctaacacggtgaaaccccgtctctactaaaaatacaaaaaccaaaaattagctgggcatggtggtgggcacctgtagtcccagctactcggctgaggcaggagaatggcatgaacccagaaggcagagcttgtagtaagccaagattgcaccactgcactccagcctgggcaacagagagagagtctgtctccaaaaataaacaaaaacaaaaaaacaaaaaacaaacctatgggatacagtaaaaacagtactaaggagtaagtttatagcaaaaagcacctacatcaaagaaagtagaaaaacttcaaataaacaacctaataatgcatcttaaatagttagaaaagcaagagcaaaccaaaaccaaaattagtagaaggaaacataacaacgatcagagcagaaataaatgaaattgaaatttaaaaatataaaatatcaatgaaatgaaaagttaatatttttttaaaagatcaacaaaatcaacaaacatttagccagactaagaaaaaagagagaagactcaaatacataaaaccagagattaaaaaggacacactgcaactgatactgcagaaattcaagtaatcattagaaactattatgaccaactatattccaataaattgaaaagcctgcaagtaatggccaggcaccgtggctcatgcctgtaatcacaacactttgggaagccaaggcaggtgatcacctgagatcaggagttcaagaccagtctggccaacatggtgaaaccccatctctactaaaaatacaaaaactagccaggcatggtggcatgcacctgtactcccagctactccagaggctgaggcaggagaatcgcttgaacctgggaggcagaagttgcagtgagctgagattgtaccaagctccatcctgggtgacagagcaagactccatctcaaaaaaaaaaaaaaaaaaaaaaaaaaaaaaaaaaaaaacacaaccaaaccacaaacctagaagaactggataaatgagattgaacccataataaaacatctcctagcaaagaaaagcctggatccaatggcttcactgattaattttaccaaacactgaaggaagaattactatcaatcctactcaaactattccaaaaaacagagaagtctgtaatatttccaaaatcattctatgaaaaagaccattcatcgtgtctaagtgggattcatcccaaggatgccaacatggttcaacatatgcaaatcaatcaatgtgacacatcatatcaacagaatgaaggacaaaaaacatatggtaatttcaattgatgctgaaaagcatttaataaaatccaacttccctgtgataaaaagaaacccccaaaaaaactagatttagaaggaacataccacaacacaataaaaaccatatgcaacaaaccctcagccagtatcattctgaacagagataacctgaaagcctttcttctaagatctggaacaaggcaagaatgtccacttccaacaatgttactcaacatagtactggaagtcctagctagagcaatcaagaaaattgaaaaacggtaaagggcatccaaattgaaagaagtaaaattattattgttttcttgtttgcaggtgatttgatcttatatttggaaaaacctaagaactccaccaaaaaactatcagaactgatcaacaaattcagagtcacacgatacaaaatcaaaatgcaaaaatcagtaacatttctaaatgccaaaactgaacaatctaaagaagaaaatcaagaacgtaatcccatttacaatagctacaaataaaataaaatatctaggaataaatgtaacaaaagaagtgaaagatctctacgatgaaaactatagaacaccaatgcaaaaaaattaaagaagacaccaaaaaaaaaaaaaaaaattgaaagatagtccatgttcattgattggaagagtaaatattgttaaaatacacatacttcacaaagcaatctacagacccaatgcaatccctattgaaatactaataacattcttcacagaaacagaaaaaaaatcctaaaatttatatgaaatcataaaagacccagaatacccaaagccatccatagcaaaaagaacaaaactggaagaatcacatcacctgacgttaaattatactacagagcaattgtaagctaaacagcatgatactggcataaaacagacacatagaccaatggaacagaatagagaacccagaaataaatccttacatttacaactaactcattttcaatgaaggtgccaagaatatacatgggggagaggacagtctcttcaccaaattgtgctgggaaaactagatattcattggcagaatttttttttttttgagatggagtctaactctgttgctctggctgcagtgcagtggcacgatctgggctcactgcaagttccacctcccgggttcacaccattctcctcctcagcctcccaagtagctgggagtacaagtgcccccaccatgcccagctattttttttttgtatttttagtagagacggagtttcaccgtgttagccaggatgttcttgatatcctgccctcatgatctgcccacctcagcctcccaaagtcattggcagaataattaaactagaactctctcttgtgctatatacaaaaatccaatccaaatgggttaaagacttaaatcaaggacaagaaactactgaaagaaaacattagggaaactctccaggaaattggtctgggcacagatttcttgagtaattactccaaaagctcaggcaaccaaagcaaaaatgaacaaatggtatcacatgaagttcaaaagtttctgcatagtaaagaaaacaatggacaaagtgaaaagacaatccacagaatggaagaaaatatttgcaaactatatatctgacaagggattaataaccagaatatataaggagttcaaacaactctataagaaaaaaactaataatccaattatttaaatgggcaaaaaatctgaacagacatttctcaaaagaaggcatgcaggtcaggtgcagtggctcacacctgtaattccagcattttggggagccaagacagttggaccacttgagcccaggagttcaagaccaacctgaaaaacatagcaaataattttaaaacctacctgggcatggtgatgcatgcctgtggtcccagctactcaggaggctgaggtgggaggattgcttgaaccctggtagtcataactacagtaagccatcattataccactgcactccagcctgggtgacagagtgagacactgtctcaaaaaatgagcaaaaacaaaaaagaagatatataaatgtcaaataggtatatgaaaagatgctcaatatcactgatcatcagagaaattcaaatcaaaactacaataagatatcatcttacccccattaaaatggcttttatgcaaaagacaggcaataacaaatgcttgcaagaatgtagggaaaagagagccctcttactctgttggtgggaatgtaaattagtacattcactatggagaacaatatggaggtccctcaaaaaattaaaaatagaactatcatatgatacagcaatcccactgctgggtatatacccaagggagggaaaattagtatatgaacgagatatctgcattcccatatttatttcagcactattcataatagccaagatttggaagcaacctaagtgtgcatcaacagatgaagggataaagaaaatgtagtacatgtacacaatggagtactcttcagccatgaaaaagaataagattctgtcacttgcaacaacgtggatggaactagggaacattatgttaagtacaatgagccaggcacagaaagactttgcatgttctcacacatttgtgggagctaaaaattaaaacaattgaactcatcaagatggagagtagactgagagtttccagaggctgggaagagtagcggtgttacgggatctttggagtgtcacttttctggacagaaacctctatggctggtggcacctttacctgagttttgcttgggccccgcccactcagcctggcaggctgtgctcagctcatgctaccaggttggatcccatgtttgccaagggagactgcgtggagtggcaaggggtgtgtgagcaagcatggggtctggccactgtgcagtcagacttcctggctgctgcagtggggcaggtagctccaggtgccaacatgggtgccagctctccacaagtctgtggctggaccacgggcaccgcaagcagcttccgcagctggcacactgggaacacagtggcacccggaagcttggagataccaggaaccacagggccccaaagagggaatcacagccctggctcggggagctcccaggtctgggcttcccaaagggtcacagctcttgtttccttctctttgcccacaatgtgggaagcaaggggcatgactcagccctgtttgtgttacagctctttcagcctcttccctaggatttgtcataattaattctcatatcgtcttatttttttacatgtgtttcaacttcagaagatgtatggatctaaacacaacatgatgtgttagctagctgccatataagtttctccctgtttcaccactatgcagcctaaagttattccgtcatcgatgactatcctggctaaagcgtctaaagatctttgtttggtagctatggcttcagctagttcattcgctaatttacctagagtggttgacagatttctaattatacgttcatgagaggttactccccaccattgcaagtgacttctgccaaacattggccaaaattcacctccttggtttgcaggtatggtttgtctaatcctgtaaagtaatttcgatgaactacttcagtgttcagaaacattggagttataaatagaaagaggaaaagtcacataaactaatagacaattacttctcatatgccagcggtcaacacattcataagcccatgggtggttgatccagggaccacacagggtccctgacagactctgaaagttaaggctttggtttactggtaacagagacaggttaaagtacatgtcttcagtcttgagtagagtgtaatcagtctcattttttttttaatgagacaaacatcaggtaaagaccttgacaagaaggaagagaaatcccgagattctataatcataataatcgaattgtaattgctagtttaagtagtccttcaaaaatacatctcattcctgacaggataaaacaagttttaaaaaatatattatattcagattcactagggaacacttggagccaggaaataattcaggattcagcccaaattataggcaaataataaaaactctaaaacaatgatcagggttggaatctaatagcatatgtcatagttttcttttggaacataaattttctctctagtccatcattttatcaaagacaaatcatagtaggaccaattttgtatgcaaaataagttttagtcttatcataccgggcctgattatttccataaagggcagcaagaatatttattggccatataggcttcttaaaattggccttgttggaaatttttaataaggaatcttttaagagccttgaagctagccaagtcaaagatttgcatcagactgtgtctgtaataattttttaacctactttttagaattatactttaagttctggggtacatgtgcagaacgtgcaggtttgttacataggtatatatattctgcagtggtttgctgcacccatcaacccatcacctatattaggcatttctcctaatgctatccctctccctgcccccaccccccaacaggccccagtgtgtgatgttcccctccctgtgtccatgtgttctcattgttcaactcccacttatgagtgagaacatgtggtgtttggttttctgttcttgtgttagtttgctgagaatgatggtttccagcttcttccatgtccctgcaaaggacatgaactcatcgttttttatggctgcatagtattccatggtgtatatgtgccacattttctttattcaatctatcattgatgggcatttgggttggtttcaagtctttgttattgtgaacagtcctgcaataaacatacatgtgcatgtgtctttatagtagaatgatttataatcctttgggtatatacccagtaatgggattgctgggccaaacggtatttctagttctagatccttgaggaatagccacactgtcttccacaatggttgaactaatttacactcccaccaacagtgtaaaagccttcctatttctccacactctctccagtatttgttgtttcctgactttttaattttcgccattctaactggcatgagatggtatctcattgtggttttgatttgcatttctctaatgactagtgatgatgagcttttttataagtttgttggttgcataattgtcctcttttgagaagtgtctgttcacatcctttgcccacttttcaatggggttgttttatcttgcaaatttgtttaagttctttgtagattctggatattagccctttgtcagatggatagactgcaaaaattttctcccattttgtaggttgcccgttcactctgatagtttcttttgctgtccagaaactctttagtttaattaggtcccatttgtcaattttggcttttgttgcctttgtttttggtgttttagtcatgaagtctttgcccatgcctatgtcctgaatggtattgcctaggttttcctctacggtttttatggctttaggtcttatgtttaagtctttaacccatcttgagttaatttttgtataaggtgtaaggaagggatccagtttcagctttctgcctatggctagctagttttcccaacatcatttattaaatagggaatcctttccccagtgctcgtttttctcaggtttgtcaaagatcagatggttgtagatgtgtggtgctatttctgaggcctctgttctgttcctttgatctatatatctgttttcgtaccagtaccatgctgttttggttaccatagcttgtagtatagtttgaagtcaggtggcatgatgcttccagctttgttctttttggttaggattgtcttggctattcgggctcttttttgattccatatgaaatttaaagtacatttttccaattccgtggagaaagtcaatggcagtttcatggggatagcagtgaatctataaattactttgggcagtaggtcactttcacgatactgattcttcttatctatgagcatggaatgattttccatttgtttgtgtcctctcttatttccttgaggagtggtttgtagttctccttgaagaggtccttcacatccttgtaagttgtattcctaggtatctcattctttttatagcaatggtgaatgggagttcactcacagcttggctctctgtttgtctgttattgatgtataggaatgcttgtgatttttgcacattgattttgtatcctgaaactttgctgaagttgcttatcagcttaaggagattttgggctgagatgatggggttttctaaatatacaatcatgtcatctgcaaacagagaccatttgacttcctcttttcctaattgaataccctttatttctttctcttgcctgattgccctggccagaacttccaatactatgttgaataggagtagtgagagagggtatccttgtcttgtgctgattttcaaagggaatgcttccagtttttgcacattcagtatgttactggctgtgggtttgtcataaatagcacttattattttgagatactttccatcaataccagtttattgagagtttttagcatgaaaggttgttgaattttgtcaaaggctctttctgcatctattgagataatcatgcagtttttgtcattggttccctttatgtgatggattacatttattgatttgcatatgttgaaccacccttgcatcccaggggtgaagccgacttgatcatggtggacaagctttttgatgtgctgctggattcagttttccagtattttattcaggatttctgcatcaatgttcatcagggatattggtctaaagttttctttttttgttgtgtccctgcgaggttttggtatcaaggtgatgctgacctcataaaatgaattagggaggattctctctttttctattgtttggaatagtttcagaaggaatggtaccagctcctctttgtacctctagtagaattcggctgtgaatccatctggtcctggaatttttttggttggtaggctataattaatgcctcaatttcagaacttgttattggtttattcaggaatttcacttcttcctggtttagtcttggtagtattctctgatgataatatgtatttctgtgggatcagtggtgatatccccttaatcatgttttattgcatctatttgattcttctctcttttcttctttattagtctggctagtggtctgatttgttgatcttttcaaaaaaccagctcctggattcattgattttttgaagggtttttcgtgtctctatctccttcaattctgctctgatcttatttgtgtcttgtcttctgctagcttttgaatttgtttgttcttgcttctctagttcttttaattttcatgttaaggtgtcaattttagatctttcctgctttctcttgtggacatttagtgctataaatttccctctacacactgctttaaatgtgtcccagagattctgggacgttgtgtctttgttctcattggtttcgaagaacatttttatttctgccttcaattctttatttacccagtagtcattcaggatcaggttacccagtttccatgtagttgtgaggttttgagtgagtttcttaatcctgcatactaatttgaatgcattgtggtctgagagactgtttgttatgatttccattcttttgcatttcctgaggagagtgttacttccaattatgtggtcaattttagaataagtgcaatgtggtgctgagaagaaggtatattctattgatttgggatggagagttctgtagatatcttttaggtccacttggtccagaactgagttcaagtcctggatattcttgttaattttctgtctcattgatctaatattgacagtggagtgttaaagtctcccactattattgtgtgggagtctaagtctctttgtaggtctttaagaacttgctttatgaatctgagtgctcctgtattgggtgcatatatctctaggatagttagctcttcttgttgcattgatccctttaccattatgtagtgcccttctttgtctcttttgatctctgttggcttaagatctgttttatcagaaactaggattgcaacccctgccttttgttgctttccacttgcttggtaaatgttcctccatccctttattttgagcctatgtgtatgagattggtctcctgagtacagcacattgatgagtcttgactctttatccaatttgccagtttgtgtctttcaattgggggcatttagctcatttacatttaaggttaatattgttatgtatgaatttgatcctgtcattatgatactagctggttattttgctcattagttgatgcagatttttcatagtgtcaatggtctttataatttgttatgtttttgcagtggctgttaccagttgttcctttccacgtttagtgcttccttcaggagttcttgtaaagcaggcctggtggtgacaatatctctcagcatttgcttgtaaaggattttatttctacttcaattatgaagcttagtttgcctggatatgaaattctggcttgaaaattcttttctttaggaatgttgtatattggcccccactctcttctggcttgtaggctttctgccaagagatccactgttagtctgatgggcttccctttgtgggtaactcaacctttctctctggctgccctttatattttttccttcatttcaaccttggtgaatctgatgattttgtgtcttggggttgctcttcttgaggaatatcttagtggtgttctctgtatttcctgaatttgaatgttggcctgtcttgctaggttggggaagttctcctggataatatccttgagagtgttttccaacttggttccattctctctgtcactttcatgtacacgaatcaaacatagattcagtgttttaacatattcctctatttcttggaggctttgttcatttctttcactcttttttctcgaatcttttcttcttgctttatttcattgagttgatcttcaatctctgatattctttctcctgcttgattgattcagctattgatacttgtgtatgcttcatgaagttcttgtgctgggtttttcagctccatcaggtcatttatattcttctctaaactggttattctagttaacaattcgtcctaccttttttttcaggctcttagcttccttgcattgggttagaacacgctcctttagcttggaggagtttgttattacccgccttctgaagcctacttctgtcaatccatcaaactcattgtctgtccagttttgttctcttgctggtgaggagttgtgatcttctggaggagaagaggcattctggtttttggagttttcagcctttttgcactggtttctccccatctttgtggatttatctacctttggactttgatgttggtgatgttgatactattcctttatgtttgttagttttccttctaccagtcaggtccctctgctgcaggtttgctcgagtttgctggaggtccactccagaccctgtttgcctgggtatcaccagtggaggctcagttggaaatgcatgaaccacctgccttctgtgttgatcccactgggtgttgcagaccggagctgttcctattcagacatcttgccagctctcctgtaatacttttatgaatgggtgtagtcctatcttctcaaggtccccaaataacttgaggttcctgggcccgtcagaaaatgacattctttacttcttaccacaaggacagcaactttgtaaaggacccttgtagacaagacaccaagccagtcattctaaggggctttgcattggtgctataaagtcaagctcaattccttaaagtggtctggttgtatctgccgttcgagttaaagccttgataaaacaaacagtgtctccaattgaatcctgttaccaaaaacagattcttattgaaattatgcaaataattatattgccataatttaggaatgctcacgaatggcttctgaattctggagaaatcagtgagagagacagataaatcgctcaaatttttgttcacaatgtagtttttctaacgtagggcaagttaaaaatagctgaaaagaaaaaaaattcttgactttggaaaacaaaacataaagagaatcaacaatgtttccaatggaagggccatgaataaaatcttttccttcttttataagttcagtccaatgtaactaaatcttgttctgcttgatttcaaatagcaattctcattcagttttttgtgttttgcttgatttcaattggaaatcctcattcagctttttagagtcctggaagattttcctagtccaatggtatgatccccaaagttatctgaaaccatatttaagagaacttgtcagagtcctttccattaaaagtaatttagatgatagctgattgtaaaggcttttttttttgagacatggtctggttctatcactcaggatggagtgcagtggcatgatcttggctcaccacaatttttccctcccaaactcaagccatcctcctacctcagcctccgaagtagttgggaccataggcatgcaccatcatgctggctaatttttgtatttttgtagagacagggttttaccatgttgcccaggatgctttcaaacttctgagttcaagcaattcacccacctcggccttgcaaagtgctgggatttttacacgtgtgagccaccgtgccctgcaccacgcccagcactgtgccctgcacagcctccagcagcacgcccggcctgtaaagggttttagagaagaactttaaacaatcaacgtggatgacaaaaacttagaatatcctttggttaaaatccagtggaagttctcgacctgcgagaaaatttagttatttctattatatgtagcattttaagataacagccagaatcatgactgacggcaacacatcagatccatcagacatccacaaattttatataatctttagaatatttatattaataatatatctatacatatacaactttagagaatatttaacatcatcaaaattatgactgataccatattagatttttataatttatataacatttaaaatatttatattaataatatacctataaatgtaaccaaaagaagatttaggccaggcacagtggctcatgtctgtaatcccaacactttgggagaccaagttggatagatcatcagaggtcaggagtttgacaccagcctggccaacatggagaaatcttgtctctactaaaaatacaaaattagccgggcgtggtggcatgtgtctgtagtctcagctacttgggaggttgaggcaggagaatcgcttgaaccttggggcagaggttgcaatggacctagatcacgccactgcactccagcctgggtgacaaagcaagattctgtctcggagaaaaaaaaaagatttagtgttacttatcttttggcaatgcttcccatacaatgttatcaactaagatttagcaaagatgtcaaaaaattgaaaacacttgaccaaaacagaatgacagtttattgttttttattttattatttttttgagacagggtctcaccctgttgcccaggctggagtgcagtggtgaaatcatggctcactgcagcctcaacttcccaggctcaggtgatcctccaccttagtatcccaagtagccaggactatgagcacttgttacgacacatagctagcttttgtattttcagtagagatgtgattttgccattttgcccaggctggacttgaactcctgggctcaagtgatccacacaccttggcctcccaaagggccggaattacagacatgagccgctgcacacagacacatgtcatttttaaataacagtcattcatttaattagaatgacaaccaaaagacatcaaaagcaacgtagaaggttacatggatgtgataactgaaaaccctcagttttcccaagtaattaaaaaaaaataaaggcaacacatggattatcttgataaaacctaaaatctttattacaggccagtcatttaaagggtaaaactcctgtggcataactgtgtcttcttacgggaagctaatttaaatcacttggaagtcaattccgatgacaaggagacttgaatttaattagacatagaaagagtgtgtccagggtcatgagtgagcataatattacaaaggaatgtcaacaggaaaaccagagcatagagcagtggggatccatagctcacaatgatagcaagaaagtttcctggttacatgaagtaattaagacatatttaaaagccaatagtataaaataagacctgatgaaaaagctgaaggagttatcatcccagccaagcaggaaacccaagccttttattccttctcaagaaggaacaggagacagtgatgtgatctgtgagtcatgtgtaacatgaaagtacaggaaaagttgaacttctgatatacaaatctgaaaagtttttatagtaacagatttcaggattaaaagtcaatatttattacctcttattatgagcaaataaatacattaagaaaaccttgttgttttaaccaaaatttttagttttttatcactgtttttaatattatagctaatttaaataaactttataaacaatctatctgatctcaatcagttttggcctcgatgtaagatttacataaacttttaataaccttgtataattttttcatctttcccaactttttacacacatgtagttttatctatcttttttattccttcaatttaaaataatccttaaaaatctctaagtgaatttactttctctgaaacaaaaaccggtatacattttgcatacagaattgtttctcttgtatctagtagtcttaatcacacatatctagcaagatattaacacttagtaacccttattttaataaaaaacctaggaagcaagaaatctggaattgtcatatagcagtatcttacatatgagaataatttcataatttagaattatgtgttcctaaaacatattttttaagatggattttcgctcttgttgcccaggctggagtgcaatggtgtgatctcagctcactgcaatctccgccccccaggttcaagtaattctcctgcctcagcctcccgagtagctgggattacaggaacccaccaccacacctggctaattttttgtattttttagtagagatggggtttcaccatgttgatcaggctggtcttgagctcctgacctcgggtgagccaccggccttggcctcccaaagtgcagggattacaggcgtgagccacagtgcctgggctaaaacataagttttaaattggaaataacccagatatttaatgagtatctattatttaatttaacataactaaaatttcaaaaataggctgggcatggtggctcacacctgtaatcccaacactttaggaggcctaggcaggagtatcatgaaaccagcctgagcaaaatagtgagatgctgactctacaaaaaaaataaaagttagctgaccatggtggtgtatgcctgtaattaacagctacatgggaggctgaggtgggtggatcccttgagagcagaaggtcaaggttgcagtgagctgtgatcatgccactgcacttcagcctgggtgacagacagagacactgtctcaaaaaaatttcaaaaatacattaagatgtcttgtatagacatttatccatttacatttacttatttttgacagtttatctagagtatttgtgagaactgaggtattagacaaagctagtcatcatttctaggttattttcttgttaaccatgttatagcctgtgaatatcaggagttcacgtaagtgaggacttcaaagttaaatacatgggtattttaccaataactcagaaaattccattatttttgttcaacaaaacatattaaattggtcttatgtatttaaaaaatcacataaacaaatattcttttttcctgtgtttatagctttataaccttcatgccaaaccctagcaccttaaaatatctagcaaatgtaaatataaaacacagtcaaaaacgtatgctgacaagtctgaagagatttctattttctatttttattttatcaatactttttaaattatttgtatttataaaagaactcttttgtctgggcacagtggttcatgcctgtatcccagcactttgagaggctgaggcaagaggatcacttgagctcaggagtttgagaccagcctgggcaacatagtgagacccaatctctactaagaataagataaaaaattgccaggcatggtggtgcatgcctattgtcccagctactagagaggatgaggcaggaggattgcttgagcctgggaggttgagataacagtgagctatgatcccactactgcactccagtctggggaacagagtgagaccttagagtgagaccttgtctcaaaaagagaaaaaaataaagaattgtttcattcttttgtttttcttcagccaagtgaccttgaattagtaacaccacagacagtaagtcttatctcaacaccagtagacaaatcagcagattcaaagtaggcagggaaaaaaaaatagataggcaaaagaactgagactttttcactttagggtttttaaaaatagtaactatttgagttctgaattttctttcatgtaatttggccatcaggtttaaagtgtgcactagaggtcaggtgcagtggctcatgcgtgtaatcccaacactatcggaggctgaggcaggtggatcacttgaggccaggagtttgagaccagcctggccaatgtgacaaaaccccatctctactgaatatacaaaaattaactgggtgtggtagtgtgcacctgtagtcccagctattcaggaggctgaggcaggataattgctcaaacctgggaggcggaggttgcagtgagccgcgattgtaccaccatgctccatcctgggcaacagagcaagactctgtgtcaaaaagaaaaaggaaaaaaaagtatatatatatgtataggctgggcacagtggctcatgcctgtaatcccagcagtttgggaggccaaggcgggtggatcacttgagatcaggagtttgagaccagcctggccaacatggtgaaacttcatctctactaaaaccacaaaaattagccgggtatggtggcacacacctgtaatcgcagctactcaggaggctgagacaggagaattgctcaaacctgggaagtggaggttgcagtgagccaagatcacaccactgcactccagcatgggcaacagaccaagactctgtctcaaaaaaatgtgtgtgtgtgtgtgtgtgtgtgtgtgtgtgtgtgtgtatgtgtgtggctagaatggtccataatatatagccagctcgagtcctagaaaacctagcaagcttaaggttagagcttctcattttggccttttcaagattaaatctcctttagtaggcccttcccctctagggaggtacttgccggagcgctgcctgaagttggttttctgatgccctgttgtttctgttctgaatggtttatttctcattataagagctcagcaaagcaggcagagttaaaaagcagagacatgaaggctttaaaatcatggacttcactcctacactgaatctcaggtccccagaaagacagaaacaccatgggaccacagcaaaggcagaaggaggagtgagagagggaggtggacagaacaacaaacaggagttggctctcattttttcacgcgtgccattttctttaggtttttctagtttatggagtctctttgttccagttgagcacacagataaactagagatctcaaggcttttgctgagaacatcaaagcctttaacctctgttgggccaaatatttagaccaaaaatacagacagacacacaaaagccagaaccggaccagattgagtagcttagtggctacagcctttattccctttattctttaggatacgaactcaaaccagattcagggttctaacccaaccaggacccccctggggtgaaactgaaaccccacagtctagacaaggttgggggtctttttttattttttatttttttgagatggagtttcactcttgttgcccaggctggagtgcaattttgcaatattgcctcaccgcaacctccgcctctcaggtttaagcacttatcctgcctcagcctcccaagctgggattacaggcttgtgccaccacgcccagctcattttgcatttttagtagagacagggtttctccatgttggtcaggctggtctcgaactcccaacctcggatgatccgcacacctaagcctcccaaagtgttgacattacaggcatgagccacagtgcccagcctgcttgttcttttcatttcatcctgatctccgaatacaggagagtagctgatttgttgttcactaacaagcacagaagctttgttacatttacagtgtcattcttggcaaaacctgaagttttgcctcctgggttcacgccattctcctgcctcagcctcctgagtagctgggactataggcgcccgccacctcacccagctaattttttgtatttttagtagaggcggggttttgccgtgttagccaggatggtctctatctcctgaccttgtgatccgcccacctcggccttccagagtgctgggattacaggcgtgagccaccgcgcccagccagaagctctaatttcaatgatgattgtgctttttctctcttcctcagcatctggctcatgataaaatttcaggtgtcttgatggtatctaaatcagttgttgattcggtcctggagaaacacaagcataacctctatgccaagttataattttacctatttcccaactttttgttattggatctctccaccaaaccagttgttctgcttctgtctttgcagctggtttctgtagatgctgttcagctgctggtaacatctggcctttgggcaggctcaaaaatttgaaagttaataatgcaagattcaattgtgtatgggctatcccgtaatccctgtttctcccccttttttgtttttattatcagttgttcgtctgtatgaaatcttaactgagcattttcaattaactgtgtggaatgacccatgtatgaagaatcagaaatcacattaacaggcatatcaaaagcagccaacacctcaattacagctacaagctccgccttttgagctgaagtatagggtgtctggaaaactttagcttttgatccagaataagaacctttaccattactagacccatctgtgaaacaatgaaaaagcttagcaggctgcaggttgtttactgcaggaattgtaaatgcaaaccgttcacagtcttgctcagctaaaagggtagtaaagaaacagtcttttaaatctgtgactattaaaggccaattttttggaattatagtagagaagggaatcctggctgttatatttccataggttgtataactgaattgatggctcttaagtcagttaacattctccatttacctgattttttcttaattatgaaaactggagaattccaaggggaaaatgttggcgctatgtgcccattttctaattgttcagtaactaatttctctaaagcatccagtttccctttgcttagcagccattattctatccaaattggcttatctgttaaccattttaaaggtataggttctggaggcttaactatggccaccatcaaaaatggtatactaatctttggcaggaactttgtctttccgtttgaagcagttctttcaaaccttgcaattttttttctactcctataccagggacatgccccatttcgtgcatcatatgttgactttgagggctgtatacttgttatggaattagaacttgtgctccccattgtcataataaatctctcccccataaatttataggtacagaagttgcaattggttgaacagtcccaggttgtccattgggcccttcacaatgcaaagtatagctactctgatacacttctggagctttagcagtttccactgtgttaaattgagtgggctgaattggccacatggacagccagtgctgtagagaaataattgaaatgtccactcctaccaaaaaaaaaaaatagtatctaccaaacctttaaagttctttccctggatagttatttcacaggtaggatgtttatcagtaatttgatttacccaataagctgccttgccttttttatttgtgcttccaaatcctccagttcatttaatttcactttttcccattcccacatacggctcactcaggagctgtgctatgcgcactcctggctgtgctttccagggaacagaactaaatatcacaatttgaatttcctcattgtaatctgaatcaatgactccagtgtgtatttgtaccccttttaaacttaaactagaccttcctaaaagtaatcccattgtccctgctcgcaacagtccacagactcctgttgggaccttttgcgggggttccccaggcagaaggctcacagcttttgtgcagcatggatctactgcagcactatgggctgtggtggggaaagataacgtatgggggtgagggaatggcctgagatggaaatgccctggtttagaacagggcctgggatgggcccctcagggagtttcccaaaatcgggttcccttctttatcaaacttagagtgacactgattagcccaaagttttccttttttacattttggacatatttcaggatcagcagttttgttttttcccctatctagtggcctgactcggtgattttttttttttttttacattctttttagtatgaccatgcttcccacagttaaaacaagctccaggaaatagagtatttcctttatccactctcagtcctgccatcgcctgtgccaacaaagtagctttatgtagattatctctgatatcatcacaggccttgttataatcaactaaatgtgctttccctctgataggtcgcagagcagcctggcaataaggattagcattgtcaaaaccaataactgcaacactatatcctaagcagccaaatctgcaatcatcttttcaagagactcctgtaaccaagctataaaatccacatatggttctcttgttccctgttttatagcactaaaggaagggtattgttctccacatgaagtgatttattccaagctctaatgcacactcctctaagctgttctatggcatcatcctgcatgaccacttgtacatgtaaaccagcccagccaccaacccccaaaagttggtctgcagttatattaatttgaggttgggcccaggcattgcgagcagcctgaatggaagcttcatctgcctactaagttttaaattgtaagaactgagcaggagttagacaagctagagtaaaagtgtcccagtcagtaggaatcatccgactggaaacagcaacattctttaacagtcccatttcaaaaggagaacctggtccatactgatttatagcttgtttaatttttttgagtgatttaaaaggaaaaggcccaaatgtagctataatatttccctgttgatctggggggtgtattcaaacagggaactgccaagcctctaaatcccacttttgtctagcttgctgtattcctgcctgaatagaacgaagaacagtcgctcaaggcgctgctcagtcaccagggcaactacttttcacccagtgtcctccagaaaagaaagatctggagggtcgttttcttcaaaatagtaatgagggtgtgcagaaggatagggatgaacctctccctccttttctgctttagctttaggtgacaaataaacctggtctgtaacctctactgttactttgttatactctccttcctcctcatcatcagtgtgaaaaagttccaaggtagaacgaaccacagcccacacttgtcctattgctaccctgatgcttccgagctccccttcttactcaccacggggattgctttaagagtactcgggtgtcctccagctagttccacattctccaatcgttgctccagcgatcctttgacctgtatttgagcccccattaatgggcaccacttgctgagaccaggtcggttggagagaccctaacccagcagcactagaggaattaaagacacacacagaaatatagaggtgtgaagtgggaaaatgggggggggggtgtcttacagccttcagagcagggccctgaacagagatttacccacgtatttattaacagcaagccagtcattagcattgtttctatagatattagattaactaaaagtatcccttattcttaaggcacagatcactcatgctattgtttgtggcttaagaatgcctttaagtggatttccaccctggacgggccaggtattccttgttctcattccagtaaacccacaaccttccagcgtgggtgttatggccatcatgaacatgtcacagtgctgcagagattttgtttatggccagttttggggccagtttatggccggatttggggaggcttgttcccaacagttcctcagggtaagggtgccctaactcctgtggggaccttctttcatggctccccaggaagtaaggagatgggaattgtgctgtagaggtctacagcagcactgcttgctgaggtgggggacaattgctgtacatttgtaagggcagtggctgtgctgggtatgcctcagtttgttgaggggcttgaggcgggtcccccttcctatttcctgaaagaggttgtccatctttgctaaatttagaatgacacggacttgcccagtgattgcctttcttacaccagggacgtacattgggacttttctgttgattgatggtagtagttttcgtcttttgaattcctttctacatttctttcttgtgtccaatttgcccacaattaaggcaagagcctgagaaatgaagcatattttttcttactcttaatctagccacagcctgagctaaaagaataaccttatgtaagttatctccaatgccatcgcaagccttaatatatttagttaaatgggccctctctgtctgggatctaatagcagtttgacactctgcattagcattattgtatgcaagaagctgtattacaacatcctgagctgttttgatcatttacggctttatacacagcctcttggagctgagcaataaaattaatatatggttctttaggtccttgtcagacagaactgaaataaggatacttttcccctgtaacatttatccttttctatgcatgtaagcacatgaagcacagctgaacaatggcaacatcttccattagtgcttgattctctaatcaaccccagttagggccaactcacattaactgatcaaagaaaacaggcacaggtggctgcacttgtgtgttttcttttgcctgagtttgatcttcatcagcctaccaagttttaaactgcaagtactgagatggagtgagaacaggttttgtcaaagtatccttattatatggtagtaatccattatcaagagccatatttttaaataaagtttgcaaaaaaagagagttcaatccatattgactaatggcttgcttaaattctttagtaacttaaaagagaaagcagcctaattagctatattctgtcctacttgctggattatcgtaacgggaaattgccatgcttcaaggtctcccttggctttagctttttgaatagaattttgtctaccaccaccaattgatccaggttttaatgttgtaactacaggagcagtaagtttttcagctaatttattttctcacccatttagaggagagagaggaggtggccattcacttaattcagcaggtggagccaacgggctagtaaaacatactttttaaagtttttctttcttttctttaatctcctctggtagctgctccccacactcagaatttgaagttagttttttacactcatcctcctcttcctcatctgagtctgcctcatcatctgtttgaaatggctcaagggctgcctttattagtgcccacactgaccatacagaaactagaatttctgctccatctttatatgccttttaaaaaatctcttccaattctctcccattcatccaacttcatagtcctttgttctggaaaccatgggcaaaactgctttactgtactaaagagtgataacaaattctaagtactaaatttcattccccatctttgtatgtcctcgggtgtcttttgatgttgtgtcctctgctttcacatgctccagccttccttcaccgggtctttgtcaccccatgttgggcgccaggaatgttggggtgatcagacccaacactaggtcatgggggtgatgaagtccggcagagtcaaaggaatgagaaaaggacagtttgagagagaaagtgggaccaggagaccatcacgagtgtggagtctgcaaagtccccaagctctgggagcccacgctatttgttggtgctcaaacaaacaggtggtgaggatttaggggttgaaaggaaacggtgtatcaagtgaatgagaaacatatggccctgcctcagcttctcttccaacactcagcttttctcccaacacattccccttatgaacaggaataaaatagggatggctgttctcaccactcctgtttaacaagtcctagccagagcaatcaggcaagagaaagcgataaaaggcatccaaataagaaatgaagtcaaattatctctcttcactgatgatatgattctacacctagaaatccctaaagactgtgccaaaaggctcctagaactgataaaaaaaagtcttcagcaaactttcaggattaaaaaaaacaacatatagaaagaagtatcatttctgtacaccaaaaatgtttaaactgagaggtaaatcaagagtgcaatcctgtttacaacagcaacccccaaaagaaaagaaaagaaaagaagaatatgtctaagcaaggaggtaaatgatatctaaaaggagaactacaaaacactgcagaaaaaaatcatagatgacaaagcaaatggaaaactattccatgctcatggattagaaagatcaatattgttaaaatggctatactgccaaaagcaatctacacattcaacactattcctatgaaacaacccatgtcgtttttcacagaattagaaaaaaatatattctaaatttcatatggatttttaaagagcccagacaaccaaaggaaacctaagcaagaagaacaaagctggagacatcacattacttgacttcatactataccctaaggccacaatagacaaaatagcatggtagcgatatgaaaacagacacaaagaccaatgaaacagaatagagaaccccaaaataaacatgcacctacagccatcagctttcccaggataacacaaagagagccatgtggcacctgcacattacactgtggaagaaaaaaccaagctcaagaaaccccaacttgtattatgggaagttcacttggctgtacccttcccaagagggagaaattatctgcattatactagacagtaaataaacttttcctttgttccagaaggaggtactggttttctattccaaggctgttttctatacaaacatgcttgaaaacaatcatttggaacaagaaagtcagcgtccatacttgcaaaatgtgcagaaattaaagagacaaaaaaactgtttctctaccaatttctatttttttaaaatcacattttccccatataatatgcttttaatatgtgataatattctgaaattgtcttagcatttacccccatttctgagtccagaaggatacaataaatttaatttaatttagtaacacttcaaatagtagtgattgtaatagcagagctagtttgtagcataaagaaaaaataataatattattaggtgacacaaataatgctagccaccatttctaagtgtcatggtaagtacagtgattattttctttttttctgactcttttttattgtattttttattttttttcccataggttattggggtacggtggtatttggttccatgaataacttctttactggttatttttgagatttgggtgcacccatcacccgagcagtgtacactgcaccttatttgttatcttttatcccttgccccccaccctattaaataatagacaaaaaataatgggtttagaataaatgagttcaaatgaattgtcaaacttatgtgggaaaagtggaatcagtttgtgagaaaaagcaaaaaactcaacagaaatgctgataaagcatcatcccttcatggctagagctgccaggacactagaacaccaaaatcagctagggaaattttgtagaagtcccagatgtactaaatgttctgtgaatacacagagatataattataactgttacctgcatgtagagtaaagatgagaaggcattggtcatggtggcagctacctcaggagttacaaagcagacgtggttccaggacagtgtatgtcagggcaaagctgtcctaggaggctattaggagttggttacggcacagacattgtaagtcagatggtctcattactttcaatgacaaaaccaaaattacttttgcatcagccaatacaacggcctggcaagagcacagaaaaaggccctgtgctgttaggtggggacctctgatgcagcacaattccttcatccccttctccgaaaccccctcttccattccactgaagagagaatctgatggaagtgctgtgtaagcaggctcagatatatctaccactatagatagtagaggtgattcataaatccaagcctatcaaatacatcataaataagttacacgtttaattttttttttgaaattagggatcatgatataaaagttatcagaatcaaaactgtcggtaatctttaaaaagaaaagaaaaaacctgaacaaatagattcagagaaggccttgaagagagggttctcatgcttctaggcctgatacaaactgtcacaaaataccgcaaaatccacaaccttgcacaaaggccatagcaaccttacacaaaatacacttctgtgaggacatctatccagcaaccacttgctcaaacttcaactgacatcgaccttgttgttgatctttatagtcaaagataactataacaaaacaattatataagcctgttcatttttcctttatttatttttttctactcccccataattccaggttgatcgcttttcttttaaagaccttgtcttcctttaccatttgaatctacacagtttgctttgtcatgcatattcccattgcagtgccctcctccctaagatgtgtctttttcctttagagaacctttctctgtttgttatttaggtttacaatgagaaagcgtgtaaagtaattttactgtcttcctaggaaaaaatcactgacttacaatatttatatttacttatttacattcctggggatgaggaattaaagatttcacaaattttcttattgagaatatcgaagttttcatgtgagcaaaactgaatatgtaaattgatatgtaaattatgctgcagataatatgctcaaatgtttacttgtatttaatttgttacacatgaatattgcatatgtaagataatatgctaagaaattatcacatttaatgaaatgctttaatcaaattcctgattgaatttttgatatcaatatctttttccttgtttaatccatctttagagtgaacagggctgtctaggccaaagtcctcacttctatctaaattgtctgagttacagaactttttgaatttattatgttgtcacaggaagtttcttattgcttgtttaaaggagtcgctctcaatatgatgcggaatccaaaagcactgaagggcatataccctgagtttctgttactgaagccaaaggttgccaatttcttgtagatccttctagagttaaacttcatttaagtattcattaaaagctgcatttattccctcacttgaacttttgatttcacactattaggactaatcctctaagtctttgctaagttatgttccttcttttcttgtggcttgactctgatgctctctatatgcaacatcaattgatgtaaagtacattcagggcaatagagtttctttaaatattactttgttattcaaaataatcacaaagcactcatcgtaggaaaacttggaggactcaaatatagggaaatactttttctttctaaggcacaattctctaaagaagttcaccttaacttgaatatacatgggaaaatatccttgttcactaatagtctatattcactctgttttcttccctcatagaccagccggttcactattattctccaaatgatgtgtgcctctctagagtccaggctatctgcatatctaatttttcccacaaattactgttttgaattgcactgaattcaattcaaggggatgtcatttataaacagtgcaaatatatactgcacgagggatcttagaaatcatacacatggtttgatccataagctcatatgagcatgcaatgtcaacttttttcatgtttttttaagtccacttaaattctattttaagccaccatctgcctgtgctgttagggcagttagccttcaatcattttaagatgctcccctctaagtaccatgatagtgatagagatatcaccagtcaggtgtcctaggaagccgattccgagttggagatttgcatgcaaggaggttgaaatgatattcccaacacctgtggaagagtgaaagcaataggattgggcggagcaggaagtcggctggaatgcaatcactatcatggccgcagtccactctacagggatcttggtgagtttacctaatgacctcgaattggagcaagaaaaccaggccattatatttctgtaccaagcagttctcggatgtgggatgccttgagaagggacatgaacttggatgaaggaactttactgtgctgtgagtgttgttgccaggagtcatctgtcaacactcccaggagacgggaaattatgctttagtcactgaggcggcatctagtgtcagaccgcagccttgttaaacagagccagattttggaggatggatggtgggtttaacatttggggcttgacgtcttgcccccacaagctgctgctggcctcttccttgtccatttctgtgtggcttgtttaggccccccagcttcctgcttcttctttaccatatttggaatgcaaaaatctacacgtaatttggcccatggtcccttctgcttagacatatccttgtagctatttttttttaaagatgactatgccttctagaatatttctaagaaattgcctaagtcaccactgctcaccaagaggcctttgttttttcctcttcttaaccatgggaaaggaatgtaggagggtagggagtggatattttctaacctggaaaaaactcattttaccctatataatttttgttagcaaattccttctttgcacttactccacaatctttccaaattctcccaaatgctcaagcttttaaaaaacaaaagacagaaagatagcaggttattaggttttccaccaaaccttttctttctattcctttacatcagtgagcttagaataactctgctcctggaactgggaaagggacttgggaaaagaaaggaaaaaaaagctctcaaagtttaacatcacaaaacattatagtcactgctattttattatttatttatttatttatttatttacttttgagatggagtcttgttctgtcaccaggctggagtgcagtggtgcgatctctgctcactgcaacctctgtgtcctgggttcaagtgattctcttgcctcagcctactgagtagctgggactacaggcttgtgccaccacacccagctaatttttgtatttttagtagagatggggtttcaccgtgttagccaggatgatctcgatctcctgaatctgtgatccgcccgccttggcctcccaaagtgctgggattacaggcatgagccaccgtgagtgaccctgctttgtaagttttacatcatatatcccctgtgttagaccaagagcttgtaaaagccagaagacatacaccatttatagttcaattagagatgttcactgataaaactgattcttccatctgagggtggtatttgtagttacagtaatgtagatgacaatctaagttatgttctataaactgtgtcactgacatctcaatctacagctaactttaattttttaaaagcagaggagtgggttgtataggtatagaaatacatccatcaagctagttaagtgagatggattcaagccttcaactcactggaatatttaccaaattgactattcattagctaaaagagccatataaacaaggtactttttaaaattcaaaattatgtaaggttttatttcctttttatgttgttatgaattggattgtagaggttataaggtaaaataagattacttttacagtaaaacatacaacatattgtcacaagagggcagcctttgaacacgaattgcttctcagacattccttgaaattttgagacagttacttaacacaacaaaataataaaacactacagaagatctaagaagatactttgacttatgcatattgttacttttttattactgctagtggaagatgtaatcgacaaggaaggtaagggctgaatttgttttatgtaaaaagacaaatttctttgggttttagctttcaaacatcaagatagtaggtcaatgtctaaatgagtgtatcaaagttctcactatggcacatggaaatccacctcttgtctacccaaaactctaaccaagcaaaggcaacttggaagattcagacaaatgtaagtgcctaggatacataaatgccacgggattttatgtttttaactttcaacctcctaagtttcactaagagacatgttgtttggagaggttgctaaagtgtatttgaatgatgtctctgtttacggttggtctggacctcttgctgtccagtggttgccctcaactgatgagagtcacctctctaaagatcatgcttacgtccctggagcagtccacagcactatcaatgtctgacgtccacctttttccaattaatatttctgtacttactgaattggaaaacatacaggtgttttttgcctggtcacttgtggttttacaacactccccccacttccccaccactgccccaggtgattttgatgccagccaaagtgtgagaactactggcagctgctggcagagagcagcaaaggcccaaatcctgtgtgatttaaagaccagtatctggttttcagccatatttccttctccttctcacagctgagtccactcctcctccctcaccacctgtaggctatgctttccagcctgtgtccaggattagtcctgatgtaaggcacgtggggtttaaggaactctctcttcagtcttatttccgcacaatctctgaaagatatattccagttgtaatcatggggctacctcctcttgtttccagtcccatgctcgttttctctatcacattctaccttgtaataacctaaatcttctggtgggcaagcttcttcctcaatcaaatttgtgtttatgattgtgttggggattggcatagtaatccaggtactgctactgccttgaaagcggagactgcatccttctgtctggatatcttgagtttctggattgtaaaccttattagggtccatttttcctagaattggagcctgtactttgttcttgctactttagttcacccagaaagcacgatctctgcctgaatttcaaagtgttggctagtttaaatatccttttgtgagacttttgtcttcctgcggggtgatttttttatcttacctatcattgctaatctttttaccttgaatgtaattgaaatagttttaatctgtgttaccagcaacaagaaccccttttatgagatgaagaggccaggtcagtctcataacgtgtgtccccctccgtgtgttgaatttatgtcagagccaggttctttcctatttgatgtctctcaccaaattccagtgtttatgtcctaggaggtgcccaataaattctagagttgatacaagctgtaattttagagaaattaaattagcaagtagatttagattatatacaacctaatcaacttttttttttttcctgaggatgaccaagatttgggcttcagtgacaatagttatcccctaaatatttatactcaatctaggatcaccagtaaaatgttgaatagagatgatgaacacacacatccttttcttgtcctaatctatgtggtttaaacatttacgctttcacaattaaatataatattgtttatatgttttgttgtggttgctttccaccacttcgagaaaatttctttttctagcttgctgagagttttttttttttttttaatcagcaatagatatttctccaaagaaaatatacaaattaccaacaggtacatgaaaaaaatgctcagcatcactaatcatcagggaaatgcaaatcaaaaccacaaagagatattgcctcaagcctgttagaatggtcttattaaaagaaaaagataacgagtgttaacaatggggagaaattggaacacttgtacagtgtttctgggaaagtaaaactgtgcagcctctatggaaaacagtacagtggttcctcaaaaaaaattaagaaagtagaactaccatatgatctagcaatctcacttcaggttatttatctgaaagaattgagattgggatgattctcaggctcattgcagcattatttacactaatcaaaatgtggaaataaggttaatgtctattggcagatgaatagataaagaaaatgtggtatattcatacaacggaatattactcagctttaaaacaagaaaatctggcaatatgcaacatggatgaacctagagaacattaatgctaagtaaagtaaatcagtcacagaaggacaaactgtatgattccacttgtataaagtatctaagatagccaaattcattagaatcacagattagaatggtgatagccccttaagttgaaatcaattttgcattcctgggttttgtagttttgctatcaggattctgactcataaaacaagtttggaatttcccccttcttctgaaataatttaaaaattttatttttttaaaacgtttgaaagaattcaccagcaaaactctttggatgtggagtttgcttatttttttattactttagttttatgtctttatgtgcaggtatttgacaatttaattactttaataaatgtcaattacttcatatattccatttaatcttgtgaatttttataagtttttttcaaggaattcaccctttcatccaagtaatgaaaattagtataaaatgtttcacaatattccattatcttgttaatgtctcttgtgtctacaactgtacaatctcattaatccctgatatttataatttgcgttttctttctttgtcacagaactaacttttggccatgttaattttctcctgtgtctgttttctgtctcattgatttctaatttctgttttattttctttcttctacttgttttggacttaatttgctctcttgctttagattttctttttaaggtagaaaattagttcacttgttttgaacttctcttttttagaataagcatttatacaaaaaatttactgtgggtctgcttaactttatcccacatattttgatagagcatatttttatttgtattcagttcaatgtattttaaggtgtttcttatgatttcttccttgagctaaagggcattttaaggtgtatttaaatcttccaatagtgtagactttcctgggtagcttgttttaacccatttcaactcattttcattatggtcagaaagcatactttctatgattacagtgttttgaaacttcttgagagatattttgtggtctatagcctattgataaatgtttcatgtgtagcataatagaacatatattctattttcttggtcaatatcggttaggtcagggtgttgtcaaaattattttaccttaactttctttagttattctatcagcaacacggcattatgtcttcataattacttgacattttatcattatgaaatagctttctgttgtaatattgcttgtttggaggtctactttttcttatattaatatagccacataagatttcttgtgcttgttgttttcttggtatacttggaaattatttaactctcaacatatctataccataatatttggcatgcatctcttataggtacttttattatatagttggacaatctgtgttttatttggagtatttaaattacgtttgaaataattattgataaggttggagttaagcctactatttttgctttttttttttttttttttttgagacggagtctggccctgtcgcccaggctggagtgcagtggcgggatctcgcctcactgcaagctctgcctcccggattcatgccattttcctgcctcagcatccggagtagctgggactacaagtgcccaccaccatgcccggctaatttttgcatttttagtagagatggggtttcaccgtgttagccaggatggtctcgatctcctgacctcgtgatccactcgcctcggcctcccaaagtgctgggattacaggctgagccaccgcgcccagcctattttgctcttatcttctatttgttccatcattttttgctcctctgttctttctttcatgcctttttatattaactgaacaatattcagcgttccattttaattcctttattggcattttagaagaatatcttcatataatgtggtggttctctagggattgtaataaacatcctgggcttatcgcagtccgcttactgttaatagtcaacgttttcatgtaacataaagaaaagttttggcaaacttgttgcttttagtctcctgtcagagctattaatttagaatattttactctacatacattatcaatagtactcttaattttttatttaaaccatcagttgtttgttataaaactaaaagaaaaaagccttagtttttcctgtttatgcacatgccattcctagagcttctccttgcttcctgtaggtcagaatttccatctgttgttatctttctttagtctaaaaaatttccgtttgcatttcttgtatctaggtctgctaatgacaattgttcaaagctttcttttatctgaataaatctttattttctcaagaattactttttctagttatagaatttggagttgacagttttttttattttgaagatgtagtttcattgctttttaaagtgtcacttctgatgacaggtcatctgtctatttgtttccaagtatgtaaattattttctccctccctttagctactttcaagatttactctttttttgcccagtggtttgactatggtatgtctacatttggttctctatatttttattctgttcttagagtttcttaaacctgtaagttgatatatgctgacaattaggaaaagttttggtctttactttttcaaatacctttttttgtcttattttcttctctactctttctaggagtccaattatattagtgctagactggtcatatttttattatttttctcctttgtattaactgtattgagaaattgttcttgatctgtttttaagtgcactgatagttttttctgccatctttcatttactggtatgtgcataaaatgactattttatataagatattctctctctcagttctaaaatttgtcctattatccctttatcatttttacttctctgttgagattctccatatattccctcttactaccatctattccttaaatccttgaatatgcttataatagcttatttcaaatttcttatcttctaattccagcatgtgggccatttcaatgtcttaatccattgtttactttttttattatgtgtcatattttcctggttctatgtctaggcaggttaaattatatcttagattatgtgtatgatattttgtagagataggctcttttattttcctttgaagagtgactcttttctaacattagtcttctttctgtagtcaaacaccaaactttcactcctgagctatatgcaatggttgaaatctctgctctgtactagcaatttagctgttgttttctgctggattctatggagtctcttttatgaatgtgaaatgtagcagccatcatatatctgaatgaagtttaagtgctgattttagatttttactctgtgacattctcctctgtgactttcagttgtgtgagatttctcccatgtcattcaaatttcccagttcttcttttctgtcagcctggaactctgtactcttattcctcaggctagtaaaactcacggctttactcttagacatctaattttgcacagactgggaagtgtcatcaggtgtgaagttacattgatgcaaatttaaatcattgcaattttctttattcagtggtcaaatacttcatcagtggttgaatattctactatttctgcctgttttctgtttctcattaccatcaaatgtgtatttaattttttttagagttaatagttttttttccctgcatttgagttagacctgagctactaccacattttgtaattcaaactttttgtctaacaatgttttaaaaaactctttatttggagggaattctcaaatttctaaatactctacaaacattaggatcagggctcacattcacagtttcccttgtagccagatgtgcatatggaacatggcctcagctaatgaagcatacccacatatttgaaagtaagaaaagtgttaagaggaactgtagatatcattttagttgacgcaaggatggaaaaaaaaataaccaactttcactggtgaactttgtcttcaatcattgttttcctgtgggtaagtggctaattttctggcctagaggtggaattggtgtgttggtaacaattgatttgatgataacctgcttttgtctttttaaaaattgtgaatccaccattgtttctggtcctgttttatacttatgcagtgtataatctctcatgcaaaatttagttctttgtttctcagcttaaactggattttgatgagcagttttcaccttcaaatgaaagaaatggctttggttgatgttagacaaaaataacaagaaggaattaaagaaatatgtttgtcatcttgtaacattaaataaatgaaactgaaaattcaacaattctgcttcataaaaaatagaaagtttctactgtttttcattattttcaaagctatatcattaaatgaaatttctgcctcatggaaggtttttagaactatgtaataataccatacagaccattaggagagaaatgaataaagactgaaagaagtaagcactgtgtggtaacatagatggcgcacagttgtgtgcatggagccctaatacatttgaccatggaatttatacaataaatgtcagtttcctgtgaacctgctaattaatatgactttctcagacatttccttaacctaaactgtttaggtttcctgtcgacagactgcatgtattctcacctttaacctttccataatcttccgtaattacagatgtcattggttcttaatagcaaaagaacagcagtagcttataaagttatattatttgttttttactaatatgtgaagtgattatgtctttcatttcacctctagagctaattatgtcttctaggttaacaaaaattccagatcaaaccatcattagtttaaactttacaatgaaatcattatttccatttattactagcctgcattatagcaatatttagctaatgaattctcaaaatatttcttgaaaggtgaaagagtacctcaagtaaatggtgtaattaatttatttatcagaattttaaattaagtgttctgtttaatctcaaaggggtaccaatgaagtcagggcataaggactttgtggttaataaaatggcaagaattaaaaaggattattacatttttcctcatactatgatggctataattttttaaaacagtagaaatgtttaatttttaaaggctactagtgtctatttcattcaaagatatgagctcttcagttcaacttgttgtttgaaatttgaacagctttttcttgctcttgttcaatacagttatttaacagtccaggcaggcctccggagttacatatatgtatgtggctatgtgtgtatatatacatagaagtacaaatagcatataaacaatttacataagacttgtgcttttgatgaaaattcttctaaaggtgaatataaattaatagcatatggggcctacaaaaattgtctaatagggaactaggaaaagataatttgtgaagaaaaagtttgctaaaacagactttttatttttacatgtaataactttatattgaagggtttccagaaatataaaatgttatagggcacttatcctgagacacacgaaggagacaagggatagagctaggatggaagtgaaaataaaggacaaatagagatagatacttaagtggaaatgaaacactgcatgttctcactcataggtgggaattgaacaatgagaacacatgcacacaggaaggggaacatcacacaccagggcctgttgtggggtggggagagggggtagggatagcattaggagatatacctaatgctaaatgacgagttaatgggtgcagcacaccaacatggcacatgtatacatatgtaactaaactgcacgttgtgcacatgtgccctaaaacttaaagtatataaaaaaaaaaatcatcaaacaggtggtaatttcaaaacatggcttttccaggcagcacattttctgaatgtatcgcaaaagaagataaattgcatgtctatgtagatcatgtcaatgaaataaacaataaagttacttattggaatattgaaagtggttgataataaataaattatttatatttatggtaaaagcaataaacttgatttttagggggttcaatgacttcctgaaaatatcctctcacagattttctcagagtgtctagttggcaaaagcacagctccaaatagctatttctgtcaacgtctacagaacatttacagtttgatttccaaaagtttccatttctactgaccttacaaatttgtaaagtgaatgcccaccaggacaaaatattaagtgataaaattaattggatcctacaagtgaaaatctaggcaaggaaaatcttcttccttcttaatgaatgatttttatgtctcttcattcttgtccttctaggtagagcaacactctggagaccttcttttgaggcatttcaccaccagagtaagtgtgatgtgtgagtaattagtctacccacagggagctggtgaaattaaattggaagttatttcctaactggcatatcctggagtaaaattaatctaataacagctttcataagagagcataagcttaaaagacaacatttttcattcaactttaccaaacaaagtgcaaatttaggtgtccagttgtgaagttttgttgtgtgtggattgtacagtgaaggtaccagtggacaacagttgctcatcaagcaagtttatacaaaagctttcggataagtccaactctagataaaattcgaaagtatttcatgcttgtgttcagagtttctttttctctctccaaggtaacccacatatcaaaagacatatgggttgtgggtagaacttcctaaaattgctgttgagaagtgtgccatgtataagcatacttcactagcttgaattttctgttagtctcacaggcaacaattacaatcctgtatgtttttctatctccacacactcctgaacatagaaagaccaagtaacatccctgtttaagatgtgtacaggttacaagacatgtctaaatatattcaccaagaggtttattattttcacagtggcattcactaaatcagttgtcagtgtagcattactcaaggaataagcagggtctttaatttatcaaagtttggagtgcaccccaagttggatcactgaagcacataactatagataagatcactcaaaagcacaaatccaggtaataaatattcactagtagtttatatgcatttagcaatttgaatgctgggaagtgtagcccagaaaatcaatcgacatggagctattaaagaggcattcatggcacctgcactttgaatctcttcagactcaggttaaacaggagacacggtagctcatgtatagtgcaaaaacccttcctctttccctttttatctatgaacctgcccttttcaatgttatctagatgcctgaaggtatgaatacccttgatcttggtaaaaaatggtaccatccatcagcaaaatctcactgatcagtgtctatgttacctcactgagttagccttttgtgttgttgtggcccagaatgacaatgttgacacaatccaaaccagtagttggaaagttaatgttggatgcgtctttgacaattgatggaatgacctgaaatcaaatgtgaggcagtggagacacaagaatgctattcaggaagttagtgatctgtggagatactaaatgaaatatctggaaggaaatgtaatcttgcaactatgcttttatgtgttttttgacataaacagtttctatttatggtggagctagagtgtccatttcccatgaagttcccatggtgttaactaatacagtcatgtgtcacttaatgacaggggtgtgtctgagaaatgcattgctggacaattttattattgtatgaacatcacagagtttacttacacaaacctagatgctatagctgattacatatctaggttaggtggtatagcctattcctcctaggctacaaacctgtgcagcatgttactgtactgaatactgtaggcaattgtaacacaacagttaagtatatctatacttacttatatctatacagtaagtgtatctatacatgtctaaacatacaagaggtacagtaaaagtacagtgttatgattttattgcaccactgaaatacatgtgcactatccttgaccaaaatgttgttatgtgatgcatgattgtaacaaaagaattaattaaatataatattgaagtgcctattgagatttcaatgaaaaaaggaatatttgtaaattctgattaccttaagtgggaattgactttattcctgtttccatggctgttcttgtgaaagagcatagctttccaaagacctgaaatctctgacaaatcttgcaattctctattgcctgcattatgaaggtcacctggtatcaaatgaggcaaaatggtagattataaagacctgtacttgtcagttcctaaacatagcaagccttggtctatcttgaacatttctgcagttataaatgagccttgggtcatgattttctgcctttttatcaaagacaagatttaatttaggagatgtccttttaatgtgtaatgtgaatagtaagtgacacttatgaagcctattttcttccagccattttaattgtcaaatctgtccagtcaagatgcattgttagaggcttcactgacaacaccgtctgtgtgtgtgggtgtgtgtgtgtgtatacatacatatgattgagcaggatttattgtaagtcaaaacagtctcaaatttcttaggacaatacagcttccttggccattcccttggagctctgagttgaggagctggtgatgtgtatttctctggcatgttctccacattatccctatgcaggcctttcatgggcttggttttggaaccagtgatgaggaagatcactagaattgttgttctcaaaaagattcctccattcttctgtataagcaatggcaattttcccagaccaatatttcttcttttgaaatggtaaattttgattattaactgattagtataatcccataaaataacaaagtttgagccctatgatctgtgttttaggctaaagttgtgttttatgctaaatcatcatttactccgtgtatgatcttttttttttttttttgagacagagtctcacactgtcactcaggctggagtgcagtggcacaatttcggcttatggcaagctccgcctcccaggtgcacaccatcctcctgcttcagcctcctgagtagctgggactacaggtgcccaccaccacacccagctaattgttttttaagattaagggtgaaataaaagctgctcccctatgttacattcataaatcagaattattaaagcaagctatttatttattagaaatacatactccaaatttagcatctaagacatgacagcctttgaagagacatcaatttactttttagggtctatagctatatttgtattcatgttattggtgtccataatatttcattagatgttctaggtaaattgataaatgaaaataatgtatgtgataaggagaacaacctaggtctcctggagggccccttacaactcagctgttgttagcagaaatgcctgggtgtaacagtgagaaacaacctttcaaaagtattgagcaatttttcaggcagaggaatatgtatgccaatccaggcagcaagataagtggaggtcagttaaaagatcagtgtgtgattacagtttttttttaggtttctactcagaggaaatataacactcagttattattttctccacatatctctggttattttgtcacaaccttttatgtaagctactaccaaacactgggttatccaagatctatgggtcgtattcaatatttgcttttccctcaactactaacacgtttgattccctttgtaactttctcccctatttctcctttcaacctgttttctccaaccacactgagttaataagcctcctatatactctcataccctgttttatctaaagagatttcctttttctactattttacccatctcattccttaatttatttcttcttatttctctctctattttttactcttttaggcacagctcatgtctcatgactttcaaaaagtttttcttcgatattcccagctcgaattaggtacatcccaatcagtttccttagacttacaagtctgcatattattggcttgcaatctgtcttaggctgggaattagctccttgtaggcaggggctagaatttatttcctcttatgtccataatgcctgacacaggaactattctcacatacaaattgtagggccataattcctgagaacatatgtatattttagtgactcataaaggcttgaaatacatttttaaaatgattaattgggaagtccatgaacttgacatcttgatgtagaagaaaagcaagggcagatgaagaagttatacaggatacttgaaataccagaagaatataatcagagagcaatacattaatcctagatttttagatgtgaagaagttctgagaaatatttgaagacttggctctagggatgagtacataacagagaccagtagccagactcagagctttaaagagtgaagaaattgcattgcagggggaaggactgttgtatactaaatagaaattgtcattaaatggaagactaagcaagaggctgatgatctgtggatgagagaccaaaatggtgtggagatagaggtaaatgccataatctacaaagaagatatttttgtgccagaaagaaataataggtctagaacgtaataaaagataaatagttaactacgttgtaatgtggtctgagaactcactgaaggcatagccattgatattaacttccactttgcttccagacaaaagattttaaatatcttaaaaattacatttgatattgtatgattcatcaagacagaaagcaaagctgtagttgccctgggggggtggggaatggggagtcacttttaatgggtacagggtttcaattttacaagacaaaaagaattatggagatgggtggtggtgatgcttgcacaacattgtgaatacatttaatgacaccgaattgtatacttaacagtggttaagatgcaaattgttgagtgtgttttgccacaattaaaaaacagaaaacaatagtatttgaagatatagcccatttcatctggtagctagctgtatgtgtctgctcagctgtggataaatatttatgctgtttctgaactggaggttactggtattctctaaggtataggaaaattgatcttatgtggctaactgaggtggatatagttgtatcagtcagacagtaatgatataatcatgatagtttacatttaacacaacttacatgtgttatactttagaaagcacttcatagatattattagttcataccattttccccttaccatatttgtctctcctttctctgctgacttcacaaaatgtctgttccacactactcagttcatctccttattttgtcaaaattttaagtatcagagtctccaaaaaaaaattccagacaagtctcatcagctttcggtcattgattaatcgatgcccttagaggctttcccttccccttctcaatttaacatagcttcccaatacacttgccagtaaaacaaagttgtttatatggttttgtatttcttcctgctgaattatgaacattttttcatattgacattgatttccatctggccatgaaatactcaaggtgaagacaatgaaacaaaattgttaatatttatcaagagccaggtactgttttcagtgtcctagaagcataaactagtgtaatgctcaccagctcatatgagaggcaaaaatggatgaaactataaaaccaagacacagagagttaagggaaatttcccaagatcacacagccactgaggctatgaactagattttgacttcaggctatttaccccagaacctgtgctttcaaccgtcatttgtactgcttccctaaattacacttgactacactgtgacatcaaatttcacctatgacactgattatctgggaaactttgcaacttattctgaatatgactcagttttcttttctgtacagagataaagtcagtatatactccatagattcgttataaggattatatgaaatgacacatgagaaggctttaaaaggacttggaaagcaataagcttttttgttttcaatcatttttcaataggttatcagtgttgtgaagggttcatgaaaaatgactttgggctcagtgagtaactgaaatgttgttgcttaatagtgtgtttaatattaatataatagtaacaaatgttgttattgttgagtaatagttatttggcttttcactgcttttcttttctagtgttttagtcagagacttcttaagtctcctcaagtgtgtacacatttcttaaatttgttggaaagtacctaatttaagatatcttgcatttttttcttccttagtaaacactaaattccatcacgcagcagaaaaagggctctgttattgtcggtacaatggtttaatattcacttttattccctatatcatagttctcatttaattgctatttagaataaaacttgttccttattatatgcattcataattataaaatttgtgttttaatgccttctacaaatatactgtgcttttctttatttccttatatcttttactgttgcatgatcctggtatttgaaatctcattaagtgttgtttggggatttgctgggaatgtcatctacatagtaatgtctcaagtttgtaacatctttaaaacataataggagatggaattcacagcagagtaataagcctcccactttaggcaatatatttgtgattgacatgactttgttcccagagggcagttagcaacacaatattatggctatgtgtacaaggaaaacaaattttaaaaatctcctttaaaaaaaaacagttcccaatcctaaccagtatcatgcacagaatccgtttccacctcttcatatggaagcagctctgggtggatatctagaaagttggataactatttatcacatatgatctgcaaagggagagatttacaagaaagtgttaaatttaatccataggaaagcaaaatcaaaaatcaatgaattttccatttgtagttttccctaggggctctactctcaagatggcttaaatgcattagaattcaatgactaggcaaaattgtttgttagtgacataaaagcaaggtaagcatttctgctttatgagtccaagcacagggacacttggttttctttggaaggatatcataaaggcaatgtttatgagtaatccctcattgtcttttcttctgtagcattcaatgctatgtactataatttagaaatgaaaactacttaaagaccacttgctaagtttcatgtatttcaaattctcagatcctgagtgtttaaatatgtcagtacttcttcatgaaaaaaacataatctttgccaagttagaaaaagaaaaagtcatattcccatttttaactaaaggtaatcagaaatttggacagtttttagctttcaatacattatgtaatttgggtaacaggctgaataaaagtaaggaacttcagttaaattcagagagaagctagtaattatttctaagactcaaatgtatagaacagatctctgatattaaggataagaccctcaaaggtgacccaaaatgggtaattgtgggattattttaagaggaatcatcatatattcttactgctataaatacagtcaaatgtcagataaatatactccactgaaatgttttctaggaatgatgttggaaccaatgttggtaattttgaaagtcatggagaggatttcagatgatagaagtcgggcaaatatcccaggtttaataaataagcaaatggtgagttccaaagctgctgtatcaatgagcctcatattgatcctgagcacaatttcagaaaggtccattaaatgggtctttggagagcacttaggataaaaggctggcagcagagattcactaagagcaatggtgccaagcttgcctctttgacattgttatctgactgataaaggtaggctatagcggtacacaatacagatatttccagggtaaagttgttgagctgctgtaattttccttgcctcttcactatcttctcctatagttgactcccaaggaaaagatagttgacttttaatctagaaatgtatgttaattggcaaaaacaaaaaaatgaaaccattaaatatcctttaggcttctctctgctcagttattagatcatatgaatgttcccttaggaaacacagaaggcccacactattatagagaaaaatttcttacattctctgctgtttaatgctcttcaaaagacttaccatacttcactaatttgattaccaactacttgaacacagggaccaatgtgcttattaaaaattttgcatattatgagggcattaacttttaagtattcgattgttaagacaatgcatattattataaaccatagaaggcacacttattacctccttaagaaccagtctctatttctctggttcatagatctccaaggttatagagggattggacatttgtgtcttcaattggccctcttcagccctaggataaatagtgattaatctaagtcaatggttttcggctctgtctgacccaatgcctctacttcataagaaattcttcaaagaccccttcactattctaaactattagtgagaacacaatgtatgcattgaagttgttgaaaatattaattttgttctgaagctaacaaaggagaaataatttactgtcaatatataatccaaaatgtatataattgtgccagaacatttacatatcaaatacaatagaacataatgaaattttcatatcttcgcccataccttgaaacattgtaaataaaaagctacaaatatagtttcattgaataaccaaatgccaaaactgccatttctattgttgacatgattgatctgcattggtaaatgtaatagatactttctgtttggcccttgtcccctgttatactcccctatttactggcttttgtccaagtggaatggtccatattgaatatctccatcggttcccttgctcattgccttctatgcatgttcatgagattaaagggaaggaggaaatgagattgggggttattgcctaactccctctctgctaggtctccttgaccaattttttcataagaaaattagtgtttccttgtgtgatcagggcagtctactccccagaactttgcctgctgctactaacccagagttattgtggggtgtgatttctgtgattccttcacccttctcccctgacattttcgtaagtagtctctttggaaataaacccatgttaaattatcttagtttgtgtgtgttctatttttcctattgagactctgaaatgagtatctaaatgaaaaaatctaccgtcttttctcatatacatagcagtttcattcttgcaaaattcatggcatattaaaaccatgcaaaagtacttgacacttaggcagttacatttgggattgtataattaaacagagcaggttattcaccttcattacattagaaagtcattcaggacatacagcaatccttaattaggagcggctatcccatgttactggacatatggcatccctgttttccaatccttaaagtttttccttaaagttccaaaatgccgtcacttattatttcctgccattggattttgtcacatgaagttgtaaggctgggaatgccatagccatcttgaaaacataggtagaaagataagagaatcacaaagaagtggatcatgttgaattaactaagcattgataccatctatttgttgtgcgatttggtcaaagttgctccttgtttttttcttcaattagtagactattctgttacttgaagctaaaaactttttttttcttttctttctttcttttttatttttgacagaaccttactctgttgcccaggctggagtgcaatggcatgatcttggctcactgcaacctctgcttgcctagttcaagcaattctcacacctcagcctccctagtagctgggattacaggcacatgccaccacactcagataatttttgtatttttagtagagatggggtttcacactgtttgccaggctggtctcaaactcctgacctcaagtgatctgcccacctcagcctaccaaagtgctgggattacaggtgtaagccactgaccctgcccaaaaatattttaaccaatagcaaagcacattatttcattacattttttcaaaagttgccagtaatttcaattaaaaatattatataacatgtttaatgcaatacaaatgcttttcaatgtacaatggggttaagtcttgataagctgattataaattgaaaatacagtaagttaaaaatgtatttaatacctaacttactgaatatcacagcttagcctggcatacctttaatgtgctcagaacacttacatcagctgacaattgggcaaaatcattgaatacaaaacctgctttataataaagtattggatattttatgtaatttgttgaatattgtactgaaagtgaaaagcagaatggttatattctattcaaagctatcacttttgcttcatcataaagtaaaaaaaatcatagattgaaccattatcagttgttgaccatctgtgtatatgtatgtgtgtgtgtacctatataaacatgtatgtttatatatatatttgtgtgtgtatatatcctcggtgtgtgtgtatgtgtgtttgagagtgtgtgtgtgtgtgtgtgtatgaaattgtagggaagtaaaatttcttatcttatagatatagcatgttaacatgttggtacctatcctcctgagatgtaaaattttacatggatagatgtgtacatttacagttgtacacaaagagaaacatattctgtagtctctttgtttttctgcagtttcattcaacactatctggtttatatggatgattacatatataatgctaggatgaaggttcttctgtataactttgaaacttccttgattatcaaccattggtatattcttagaataggattttattttagaattaagatccttgtttcaggactctagactgttaacacacagagccaataattattcagaatggttgggttagttcacattcccacagatgagacatcaaatgtccaggctgcacagcctcattaacactagatattctggacattttatatagtatttcatctgatataaaaagtagaattctaatttgattatggttgttaatttatttttaactttttagtcattatgaaaatgtttaactatatgaaaagccaggaaagggttttttttaaggtagtacttcagaaatatttatgatacttaatttttaaaaattaactctaaaagaatcttgaaatgtctgtttaataaaataggacacaaatactggtcacattagtgaaaaatatttgtttaaaattaaaatatctgcagcaatcatgtagatattaataattttttaaagaatgacatcttcaaaatataactgttctaaactaatatgtctccattaatacatatagatacatataaataaataaatttgaagacttcaaattccaggtacaatataatttttttctatcctgtgatttgtcattcaggattttgtaatttgaacagaaatattttgccctaaccccatgtctgtcttttctcttacctaaaaatattattttatgtaaaattgttttaaaggtcagtttgcacgtttgaaaagcatcttgtacaatgttacataatatattgcatatttggttacattgttttaactgtgtaaatatggtttaaatctgtaatgctctttagtgctgatcatgatgcaaatcaaatttatctgtataaaaggctcctgttaatttttttttattatactttaagttttagggtacatgtgcacaaagtgtaggtttgctacatatgtacacatgtgccatgttggtgtgctgcacccattaactcctcatttaacattaggtatatctcctaatgctatccctaccccctccacccaccccacaacagtccccagtgtgtgatgttccccttcctgtatccatgtttcctcattgttcaattcccacctatgagtgagaacatgtggtgtttggttttttcccttgcaatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacgtgtgtatgtgtcttttgagcagcatgatttgtaatcctttgggtatatacccagtaatgggatggctgggtcaaatggtatttctagttctagatccctgaggaatcaccacactgacttccacagtggttgaactagtttacagtcccatcaacagtataaaagtgttcctatttctccacatcttctccagcacctgttgtttcctgactttttaatgatcgccattctaactggtgtgagatggtatctcattgtggttttgatttgcatttctctgatggccagtgatgatgagctttttttcatgtgtcttttggctgcataaatgtcttcttttgagaagtgtctgttcatttcctttgcccacattttgatggggttgtttgttttcttcttgtgaatttgtttgagttcattgtagattctggatattagccatttgtcagatgagtaggttgcaaaacttttctcccattctgtaggatgtctattcactctgatgatagtttcttttgctgtgcagaagctccttagtttaattagatcccatttgtcaattttgtcttttgttgccattgcttttggtgttttagacatgaagtccctgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccctatttcttgtttttgtcaggtttttcaaagatcagatagttgtagatatgtggcattatttctgagggctctgtcctgttccattggtctatatctctgttttggtactagtaccatgctgttttggttactgtagccttgtagtatagtttgaagtcaggtagcatgatgcctccagctttgttcttttgccttagaattgatttggcaatgcaggctcttttttggttccatatgaactttaaagtagtttttttccaattctgtgaagaaagtctttggtagtttgatggagatggcattgaatctttaaattaccttgggcagtatggccattttcaagatattgattcttcctacccatgagcatggaatgttcttccatttgtttgtatccttttttatttcattgagcagtgatttgcagttctccttgaagaggtccttcacatcccttgtaagtggtattcctaggtattttattctctttgaagcaattgtgaatgggagttcactcatgatttggctctctgtttgtctgttattggtgtataagaatgcttgtgatttttgcacattgattttgtatcctgagactttgctgaagttgtttatcagcttaacgagattttgggctgagatgatggggttttccacattcacaatcatgtcatctgcaaacagggacaatttgactgcctcttttcctaattgaatgccctttatttccttttccttcctgattgccctggccagaacttccaacactatgttgaataggagtggtgagagagggcatccctgttttgtgccagttttcaaagggaatgcttccagtttttgccattcagtatgatattggctgtgggtttgtcatagatagctcttattattttgagatacgttctatcaatccctaatttattgacagtttttagcatgaagatttgctgaattttgtcaaaggacttttctgcgtctattgagataatcatgtggtttttgtctttggtcctgtttatatgctggattacgtttactgattttcatatgttgaaccagcctttcatcccagggatgaaacccgcttgatcatggtggataagctttttgatgtgttgtaggattctgtttgccagtattttattgaggatttttgcatcactgttcatcaaggatattggtctaaaattctctttttttgttttgtctctgccaggctttggtatcaggatgatactggcctcataaaatgagttagggaggattccctctttttctattgattggaatagtttcagaaggaatggtaccagctcctccttgtgccactggtagaatttggctgtgaatccatctggtcctggactttttttggttggtaagctattaattattgcctcaatttcagagcctgttattggtctattcagagattcagcttcttcctggtttagtcttgggagagtatacgtgtcgaggaatttatccatttcttctatattttctagtttatttgtgtagaggtgtttatagtattctctgatggtagtgtgtatttctgtgggatcggtggtgatatcccctttgtcaatttttattgcatctatttgattcttctttcttttcttctttattagtcttgctggtggtctatcaattttgttgatcttttcaaaaaaccagctcctggattcattgattttttgagggttttttgtgtctctatttccttcagttctgctctgatctaagttacttcttgccttctgttatcttttgaatgtgtttgttcttgcttctctagttcttttaattgtgatgttaggatgtcaattttagttctttcatgctttctcttgtgggcatttagtgctataaatttccctccacacactgctttgaatgtgtcccagagatactggtatgttgtgtctttgttcttgttggtttcaaataaaatctttatttctgccttcatttcgttatgtacccagtagtcattcaggagcaggttgttcagtttccatgtagttgagtggtcttgagtgagtttttaaatcctgagttgtagtttgattgcactgtgttccgagagacagtttgttatactttctgttcttttacatttgctaaggagtgctttacttccaattatgtgctcaattttggaataggtgtggtgtggtgctgaaaagaatacatattctgttgatttggggtacagagttctgtagatgtctattaggtctgcttagggcagagctgagttcaattcctgtatatccttgttaactttctgtctcgttgatctgtctaatgttgacagtggggtgttaaagtctcccattattattgtgtggaagtctaaatcactttgtaggtcactaaggacttgctttatgaatctgggtgcttctgtattgtgtgcatatatatttagaatagttagttcttgttgaattgatccctttaccattatgtaatggccttctttgtctcttttgatctttgttggattaaagtctgttttatccgagactaggattgcaacccctgcctttttttgttttccatttgcttggtagatcttcctccatccctttattttgagcctatgtgtgtctctgcacgtgagatgggtttcctggatacagcacactgatgggtcttgactctttatccaatttgcctgtctgcaccttttaattggagcatttaacccatttacatttaaggttagtattgttatgtgtgaatttgatcctgtcattatgacgttagctggttattttcctcgttagtttatgcagtttcttcctagccttgatggtctttacaatttggcatggttttacagtggctggtaccagttgttcctttccatgtttagtgcttccttcaggagatcttttagggcaggcctggtggtgacaaaatctctcagcatttgcttgtctgtggagcatattatttctccctcacttatgaaggttagtttggctggatatgaaattctgggttgaaaattctttcctttaagaatgttgaatattggcccctactctcttctggcttatagagtttctgcagagagatcagcagttagtctgatgggcttccttttgtgggtaacccgacctttctctctggctgcctttaaaattttttctttcatttcaactttggtgaatctggcaattatgtgtcttggaattgctcttctcgaggagtatctttgtggcattctctgtatttcctgaatgtgaatgttggcctgccttgctagattggggaagttctcctggataatatcctgcagagtgttttccaacttggttccattctccccgtcactttcaggtaaaccaaatagacgtagatttgttctattgacatagtcccatatttcttggaggctttgttcatttctttttattcttttttctctaaacttctcttcatgcttcatttcattcatttcatcttccatcgctgataccctttcttcccgttgatcacatcggttactgaggcttatgcatttgtcgtgtagttctcgtgccatggttttcagctccatcaggtcctttaaggacttctccacattggttattctagttatccattcgtctaattttttttttcaaagtttttaacttctttgccattggttcgaacttcctcctttagctcggagtactttgatcttctgaagtcttcctctctcaactcttcaaagtcattctccgtccagctttgttccattgctggtgaggagttgcattcctttggaggaggataggcactctgatttttagagtttccagtttttctgctctttttttccccatctttgtggttttatctacctttggtccttgatgatggtgacatacagatggggttttggtgtggatgtcctttctgtttgttagttttccttctaacagtcagggccctcagctgcaggtctgttggagtttactggaggtctcctccagacactatttgcctggggggtatcagcagtggtggctgcagaacagtggatattggtgaagtgcaaatgctgctgcctgatcgttcctctggaggttttgtctcagaggggtacctggccatgtgaggtgtcagtctgcgcctactggggggtgcctcccagttaggctattggggttcagggacccactaggtgggggttgtctgcccgttctcagatctcaagctgcatgctgggagaaccactactctcttcaaagctgtcagacagggacatttaagtctgcagaggttattgctgtcttttgttggtctgtgccctgcccaccgaggtggagcctacagaggcaggctggcctccttgagctgtggtgggctccacccagttcgaacttcctggctgctttgtttacttactcaagcccgagcaatggcgggcgcccccctcccccagccccactgttaccttgcagtttgatctcagactgctgtgctagcaaacagcgaggctccgggggtgtaggaccctccaagccaggtgctggatataatctcctggtgtgccatttgataagcctgttggaaaagcgcagtattagggtgggagtgacctgattttccaggtgccatctgtcacccctttctttgactaggaaagggaattccctgacccctagtgcttcccaggtgaggtgatgccttgccctgctttggctcatgcatggtgcgctgcacccactgtccagcactccccagtgagatgaacctggtacctcagttggaaatgcagaaatcacccgtcttctgcatcactcacgctgggagctgtagactggagctgttcctattcggccatcttggctccaccctctaatttttaactttcaaaagattagatacatttaccctcttctgaattttaattcctgatggaaagattgtgaaatctcaagaggataatgaatcagcttctgattatattctggaattgcgattttatcacacatccaagaatgcgtattcactttcctttacattacacacatgcataataccatgctgagtgatgctggaaaaagtgagtcttcagtaatgccctcatgaaattacagtctcactacactgaggtattttctttttaaccctttctttcttttctgctgtgaatatgtgtcttctaagaggtgaacaatgggaaaaactgaaaaagaaccttcatctaattcagtaactagcttttgtatcttctaagaatttttatctccagaaagctctaattttcattcctttacaagctttatttctctctcctttccaacaccagactttgctctgtttgttttctatatcttttttagagatgcctacaatagaaaaaaactatgacatattcaatacatctgaaaagtttgcattaccatagataagaatgaattatctgtttataaagaaaaaacaataaaaatatgaaccaagaaagcacagaaggtagtaaccacatttagatgtttatcatggaatcatctttataatccatctgttacaattccacagagcaaattacaagtaattgtgaagtttcccctcattttataggtttggtcttataaggcatacaacacaaattttaattacttttctttttggtatttggatcttaatttggtcaagtggccactgggtagatgatggagcctcttgagacatacagtcttcttctagctttgttgatgtgaatattactgtgtatttttcattcacttattattttacaaggcatacttcattaaaaatatatcagcatctcattgacaaatcacaaaatttaaaaggcaccagaaaaaaacaatttatttaaaacattcctgtgtaaaagtagtcaccactcttactattcttcaaatatttttattatatttaaacacaagcctagttttatctcgagtgtctgaccttgatgatattgtacactttaaacttagaaaaattgaactctattggaaatttcctacagatcagcttttctagatgccaagtgccttgtttcagccatggtgatgacagcaaattgggttctcagggattctggcctctggcatcatctcagttgtttataattgaagttgggtctgatgagaacgcagcttagatgcatggtgggactgctgggcttaaggctggcctgccaggaggttgcattgaggtgtaactaggcaaagaaagaaggagtttattgaggcactactgacaatagcaaagacttggaaccaacccaaatatccaacaatgatagactggattaagaaaatgtggcacataaacaccatggaatactatgcagccataaaaatgatgagttcatgtcctttgtagggacatggatgaagctggaaaccatcattctcagcaaactatcacaaggacaaaaaaacaccgcatgttctcactcacaggtgggaattaaacaatgagaacacatggacacaggaagaggaacagcacacactggggcctattgtggggtgaggggctaggggagggaaagcattaggatatatacctaatgtaaatgacgaggtaatgggtgcagcacaccaacatgtcacatgtatacatatgaaacaaacctgcacgttgtgcacatgtaccctacaacttaaagtataacaaaaaaaagaaggggttggacaaaattaccaacaatcttcaactatgaatttgtatgagtaggggcttcccacaccatcaggcactccaagttggagaaacaagggatgttgaattgaaagtttaattttttaggcttgatagtcagattagggaagttttgggtacacctttcccactctagagccctctccctaactcagggccaatttgggacatgggctcagtggaaaagagtgtcaagatcaattagaaatatccatcatgaacataggaggcaggcattctggccaagggggtgcgtcttcccactttgtaatccagagtgcgatttcttcttgctatctgtccctccataaataagcgttgggtgaaggacaagctagttaccattgaggatggaatgaaattctaccagaattgcaaaatgaactgagagccacgaaagttttcctctgtgaaccagcagagagatctgtggaaggcaaaggaagaggagccaagaggccagataacattcctgcttcccctacattgtgagagtgaaattgtcagcaacctatatcagtaattaaccagaggctttttagagagtaagacttctgatagatacctcaatagctgaagttgctcttcagtactgcatataacctgtggacagattttcatcattattaattcatttattcaacagatagatattaaattcaaggcatagttctaaactatgcagtcaattacaaaaaaaataataatgaaggacattagctctgcctcataggacgttaaaactctagctgctaaatgagacaaatagggttcccacatcaagtgcctgggctcctgttataaactgggctctgcttccattggcttctcttgtttctgttttgataaacccatcatttggcttagtccctacccttgccatgctcacccaccagtaggtggacctccttgaccataactatagacatagatctttgattgtttcttttcaaatatttgcttactttagaagtgcagtcaaatgttgtttggaccataagactccgaggctgtgtgtggttgaaactgtcttgagactcaaagagctattgaggaagggatttgatagctgaactcttttgaagattttctctgtctctcacacatctggggctgaatagcttaacgtttaatttctacatcgacgatagtttaatagccattcatgcaaatcagttctgctgtgagttattatcctactccaataccaactaacgcattccttaaatttagtgtacgtataaattctacatggtaagtgaagctgtctttatgaattgctgctatagaatatactagattgtgtaggttttagtacaatccaggtaattatcaagcctttgtaatattttcaggaaagtgatcctttcactttagtttatggaacttgaaaattttttagttgccaccgactagttagatcataaacttaattctatgtagctgaatttatttttctatttataaatttatctgggtgctttctcaaaagtttctcagattaaaaacctatggctttgtaaaattaaaacagaagtaataggaattgtgttaaaaaacagaatcaggccaagcctggtggcttatgcctctaatgccaacacttagggaggccaaggcgggaggatcatttgaggtcaggagttcaagaccagcctggacaacatggcaaaactccacatgtattaaaaaaatacacaaattagctgggcgtggtggtgaatgcctttagtcctagctactcaggaggctaaggcaggagaatagcttgaacctgggaggctgaggttgcagtgagccaagatagagccactacattccagcctgggtgacagagtgagatcctgtcttaaaaaaaaggaaaaaagaaaaagaaaaaacagaatcatacaatgagagagattgtatagcccttttaattgtccataaaggatacatttctttttctgtgtaatagtttatcagcatgaaaattttctttttctgtgtaatagtttatcagcatgaaaaaaaagagtcactgaacactgataattttctttctctctctctctctctttttttcctttttttggagatgaagtctcactctgttgcccaggctggagtgcaatggcaacatctctgttcactgcaaacttcacatcctaggttcaggagattttcctgcctcagcctcccaagtagctgggattccaggtggaccccgtcatgcctggataaatttttgtattttcagtagagacggggtttcatcatgttggccaggctggtctcaaactcctgacctcaaatgatctgcccgccttagcctcccaaattactggtgatgattttcatttaatggtgttctacaaagtgagtttaggcagtgaaagggcacaagtcacctatagtttaccggaaagtagtaccagtcaccagcgttgaagcatactcctaaccctggaaaatttcttcagcagccagaattaatctcagattttgagactggagcaaagactaatttggtatgtgttcattcagattagtaaatctccatggtgttcgaactgtataatatcaaatctaaaataagtcaagagagttggacaatatctcatctctgagaaaaaaaatgcattattttcaagagatttaagactgaatttaaaatccaactgcctattccagtgtatgtttctctagaataagaccaagccatacaaattctggatagtgtcctccaagttgtgtttaagtgataattgataaatctatggtttagatacatatggaattccacataactctagctccagcctttgcgagtaaaaattggcagtgatcatggccttaatggaggcatgtggttaattggaattttcagtaccaaaagtcttcttcttactagtttatcagggtaccctataatagtatccataactcattgcccacttgtctgttttgatttcttttttaaaaatacaattttaaacttagaggttttgtacctcaagtcacatatgtggcacatttataaaataatcatgcctttgcatatttttcctttgatatcttagctgtatatacaagccacttatgttttttaattgccacaaatattgcactgaaatagagcactagttgcaaaaatgcctggtataacatttcttcttgttcttgaaagtaattttaataccccatgtttaagatattcctagacaactataagtaactataattatttctgctaggtagaagcatctttgtggtcaacatttgtgaagtgccttgtaaataaaaatatgcttgagtagaaatagtattttgcaaatatagccctaaatagagctactgattttaccaaaaattaaggactccaaactctgtctttgtctttcaaatttggtttataggaacatctcattacaatgagcaaaaagcctatctgatcactaaagagataattttgacacttccaaatgacacagctaatttgtagtaggtttttgaagtgcaaattacatgtttctgtttaaataatgacagtaaaatatggacagtatctattcacactctatatacacaactacaacttgtccctagaagaaaagtttaatttttcaggtctcatccacaaaacgaagtgttaataagctgtatctttatactcacttttaagtaatttcttcttaaccattgtataacactaccacagtttgtatggagataaaataactcatggtgagaaatccagttctttaaaaaatcattttaccttcaatcacttttaggatgtctatggttttagagtaaggacgaaaatttataaacatttgttaaattatgcaactgtgtttgaagatgtttcaaaattacattttccttattttacaactagttttcatgtattcacaaacgagacacatgagaattattaatgcaaaagcacagcatatcaacaaagtttataatgtaaatagtttagttaggaaagaatgtaatgagtgaattatcaaagctattttattggttcctagatttaccacagaagaaaataaaacaggcttttaaaaatttctcagcactgagaccatttaaggtctattttgtatgccgtaagttctaaaaaatgttattgctggtaaaaataggatgcctatctaaaattgtctttttaaaggttctctcttattcttcttcccttcctatgtgtgcatagaatactgtcatcgtcttgattggaacactgtctctctttctcagagggtgtacatttgtagaagggagaaaatatttgttaattttgcttcctataagataaggtctcaatggttgaaggtcagttaacaaactttttttttgtcttcatactattatcttggaattaccaactggcttctacttagattttgaataatgaaagaaaagaactagcatttgttggaacttactgtgttccagaaactttattgatgccatttcttctcattatcacattcattctttcaattagtattatttttttccatcttaatgaggtgggaccagaggttttgtaatatccactaatccactgtggatttcatggattgcaagaggaagaaagcatggtggaactcaggtttctctgattccaaattcacatcctttcatgtctccatgaaaaatagaaaagataaattgggctctattctaacaagagaaacacaattttccgtcagttaaatgaataattcttttttattttattttattttatttttattattatactttaagttttagggtacatgtgcacattgtgcagattagttacatatgtatacatgtgccatgctggtgtgctgcacccagatacctaaatgaataattcttaaacctcaaaaataaaacgtagcaaaacctcaattcaagagtagacataaaggttgtgacatgggtagcagggacatatgtctagtgacagatttcctatgcatatctgaccaaaaatccccctcatgattttcaaatcagatgcttaactacatttaatgagtttcccgaatcattaatatcaggctctgaaaacaggatcattaaaaatgattaagactttcaacaacaaatatcttatctaaatagtaaggaaattatattagatggctccattccctgggcagtctagttaacaattcgacttgttcaaagctataaaatatggcaacttaaaaaattatgaaagtttttctaactttgtgcttaaggtagttggccattcttcctcttgggaataagaagggtagattttctgtcgaagcatttttctattgcttttcaatttccttttatggaaaatagataaaatagcaattttttaattataaatttaaagtcaaaatggagataattaagtatctccattaattaagtaaagattaattttttttaaaatagcatttactatattctaatcaatcaattgattgactatttttatccctggctcaatgtaactctctttgacatactcttgtcttaattctaatttaagtcaacaatgtgtaatcatagatgactccttgccattttgatctctcagttctatgaacacctttgatctaacaataatgttttccaacagaattatttctactcaaacttctgagatcaaatttgtggattcagtctcaccccaatcaattcttcaactctcaggacaccaaatggtgtcctacaattcaattcaatcctgagtctatctatctggagatagcatagatcccaaaagttcagggctcaggcccacaagactgcccccacaccattagagaggagttgtgggcctcccatactcctgaccaactgtctataaattaggacctccatggattccttcctcaggttctataatttgctaagatggcgcacagaacccaagaaagcactttgttacagttactgtctgatacaaatcaggaactctcaaatagaagagacacatagggccaggtatggtgaaaaggggcacaaagctgccatatgacctctaagtatatcattctatcaccctcccagcacctcagaggtgatggaggagagggctgacagtttcaaccatctagttatgccttcatgtttctgatgtccagcacacaccctgaagctatacgggtctccagccaccactcatgtcatgtcaatagcataaactcaggtatggctaagagagacttatgactagtaaaggatggtcctctcatctctatcaggaaatttcaagttttaggagctctgtactgtgaactggggaggaagaccaaataggacatacactagaccagttgtgctaactacagtgtgcctcaaaattgcctacagttgtgttacaataaaagattgctgagacctgctattggaatttcagatttggtagatctggggctgtaacctgagaatatgcacttctagtaagttcccaggtgatgctgatgctgctagcacagggaccacacttccagacggactgagtgaagcatcgtcattacttataataggaacttctctgtagtcacaattttattcatcccattctctgagctcctcctttaatcattccctttcatatgctgacataaaatttttcaatctctctgagacctccaaactattattttatcatattcacaatgacccttacctacttgatgtactctatttcctgttctcctgcctaaattccatggccaaccattcccaggaaacttcaacttcctggtttctctttcactttgctgaatataaccaggaaaataaccctggttatatccaaatttccaccaaatccccacatatatttgagcaactagctatatggatcaaattgaaaaatatcccacttgaaaatgagaatctcagtgctgcctatcaatcaatcatactacatatgttccaatctattcattctctaatttacctagttttgtatcttatcctgtctctaatccctaacacttgcccagaaatcctcaatgtctttttggttgtgcttccctgagaacactgaatcatccaaagacaacttccacagactcctgaaaccatttaaactcactttcccgtctacacccacatactctccattttcacctattattatctgtgaaataaatggcccctatctgtatattgtctgatgatgatttctatattacaggtgaagaaaatgagaatagggttagagctactttctcattatagcatagctaagaatcaaatccacgcagtccaccactgaaactggggttccaagtcagtgtatttggagaaggagagctagtagaaaaataaggatgaaaagatccaggatgaagcttctgatggaagaaaaggacatttttactattatgaactccttgaagtagaccttaagcattctcatctggacaaatatccattcatccactccagtgagctgattaagttttaggattttaagggtcagtgaacatttattcctcattcagcaattaaagaaggattaatatgaatattatcttggagaagtttaatttaaaatatatttgattgattttcggcaattgtcttctatcagatcattaccaatccatatgaattggtaggaagggagaaaacccaaaatttaatcagatgcctgaagttagggaacattttataaccaacccagggggagaaaaatgctcaaaaggggaaagatgaggacagaaaatacatttcaaagattttaactttttgacaaaatgtcatttctgtgcaagaaaaactgattgtgtgaatataactgtcatttacatctgccaatgtgttcagaaatatataacctataatttttttaatagtagtttgttaaaacaaaatttattcatcaaagtatctaaaacattctaaaaatactaaaaattttcagtttaaatattaagctaaacagctctgtatatataaataagctcaaacaaacgtgcatgcttcccaacaataacactgctacagatattgattggtggttttggtttcatttcattttataatggcaaatctggttaaaacccagattctgggctgggcacagtggctcacgtctgtgatctcagcactttgggaggctgagacaggcaaatcacaaggtcaacagatcgggaccatcctggccaacatggcgaaaccccatctctactaaaaaaaaatacgaaagttagctgggcatggtggcacgtgcctgtagtcccagctacttgggaggctgaggcaggagaatcacttggacctgggaggcagaggttgcatgagctgagactgtgccactgtactccagcctggtaacagagagagactccatctcaaaacaaaacaaaacaaaacaaaacaaaacaaaacaaaacaaaaccccagattctgaactgactctcacaataaggatctcaattgcttcaaagagaataaaacacctagaaatccaacttaaaagggatgtgaaggacctcttcaaggaaaactacaaaccactgctcaatgaaataagatacaaacaaatgtaagaaccttccatgttcatgggtaggaagaatcaatattctgaaaatggccatactgtccaaggtaatttatagactcaatgccatccccatcaagcaaccaatgactttcttcacagaattggaaaaaactactttaaagttcatatggaaccaaaaaagagcctgcattgccaagtcaatcctaaggcaaaagaacaaagctggaggtactacgctgcctgacttcaaactatactacaaggttacagtgaccaaaacagcatggtactggtaccaaaagagagatagaggccaatggaacagaacagagccctcagaaataatgccacatgtctacaactatctgatatttgacaaacctgacagaaacaagaactagggaaaggattccctatttaataaatggtgctgggaaaactggctagccatatgtagaaagctgaaactggatcccttccttacaccttatacaaaaattaattcaagatggattaaagacttacatgttagacctaaaaccataaaaatcttggaaaaaaactaggcaataccattcaggacataggcataggcagggacttcatgtctaaaacaccaaaagcaatggcaacaaaagccaaaattgacaaatgggatctaattaaactaaagagcttctgcacagcaaaagaaagcaccatcagagtgaacaggcaacctacagaatgggagaaaggtttgcaatctactcatctgacaaaggacaaatatccagaatctacaatgaactccaacaaatttacaagaaaaaagcaaccccatcaaaaagtgggcgaaggatatgaacagacacttctcaaaagaagacatttatgcagccaaaaaacacatgaaaaaatgctcatcatcactgcccatcagagaaatgcaaatcaaaaccacaatgagataccatctcacaccagttagaatggcgatcattaaaaagtcaggaaacaacaggtgctggagaggatgtggagaaatgggaacacttttacactgttgatgggactgtaaactagttcaaacattgtggaagtcggtgtggcgattcctcagggatctagaactagaaataccatttgatccagccatcccattactgggtatatacccaaaggattataaatcatgctgctctaaagacacatgcacacgtatgtttattgtggcactattcacaatagcaaagacttggaaccaacccaaatgtccaacaatgatagactggattaagaaaatgtggcacatatacaccatggaatcctatgcagccataaaaaatgatgagtttatgtcctttgtagggacatggatgaagctggaaaccatcattctcagcaaactatcacaaggacaaaaaaccaaacaccacatgttctcactcataggtgggaatttaacaatgagaacacatggacacaggaaggttaacatcacacactggggactgttgtggggtggggggagtggggagggatagcattagaagatatacctaatgttaaatgacgagttaatggttgcagcacgacagcatggcacatgtatacatatgtaacaaacgtgcacgttctgcacgtgtaccctaaaacttaatgtataataataataattaaaaaaaatgaaaacatatgtccacacacacacaaaaaaaagaaaaaaataaggatctcaaagaggtcactatgtatataatctattcttaaagaaaaattttctccaattgtttaatgaaatatcacacagactctgactttgtttatacccttaaaaattatgtagatttatgtgtagcttttgtaaagtgaaagctcagaatgtctactctgttctggtaccactttagtttaattgttgggaaatatttaataaaaatgaattactcaacaaatggaaaatttgaactttgcatactaaatttttacttcatattatcaactcttgaaaaataagtgtgtatattagaaatgacactcatttgactataccataatatatttcagacattttatcttcagctacagaatttctccatcctttgaattatgttagagggctttagttggccagtattggtgattcgcctccactaattcacaactctattgtcttacccccggggatgcatttccatagttctgccttgttatgagtgtcatttttttcttctgttttgttgactgccattcaaatagttttggctttatcagagattttcactttattgtcaccccctcatttttttaacttctcataatttactgtattatatctgcctgggcttttggttcctttacagatttgtttcactttatttttagcttatgatacttctaaagtctgtatccttttaattttcacttgcttcttcgtcacattcttgtgttttgttttcatttcaaaataccagaaagtaggatgtctcagcatcttggtgagtggaatagtttatttataatccaaaaaaatcccccatactttttgtgagctatctgcttctaagtaaaaattttatatataaattcttgaaaaaaatattaaacttctgagggattgaatgagattttaaaaatcattctatacaacaatgggtgcaaaatttgtattcctctactcaagagaaatcatgaacattttttattagtttactaacatctaaatattaatgtattcaattatatattattaaaacacgattaagcttaagaggtggaaaagtataaaacaaacaagtggataatctacctttattaatatgaaacatctttttctctcctgaaaataaagattaaccaggggtgtgctggggcgggagggggtgtgttggagggagaaaagccatgatttgccaatttcagcacaaaactgaaaatggttattaatctttactagctacagatatcttttaacatatattgaaatctatgacccttaaaaagaaaacatatatacagattttgacaaaactttgcagttccactcatggatccttgtataagaatcccttttatatgtgtgtttgcaatttaaagagttcagactttatgattcacaggtgacaattaatgatttaaaatcataacttaggcttttataatttgggagtcaggtgtttaactgctgtagtagtaactgcttcttctcagagaaacttaggagctaagaccagggaaatgtcccttggtgtgcaacacacctcttctttctgaacatatcgtataagaagctaactttgtctcaaagtttatatgacttttgcatttgcagttactagctattttcttttggaactgttggagttggagaactttccctctaccctctgaaggtgtgataactgagtctattgaataaatggataacaggcatgtcaaaagaagaaaatgtgtacacatttattacacgcatgggggaatcacaggaaagaaaagtggaatcaaaaacaaaacaaaacaaacaaaacaccaccaagaaaaaaacccagtgagatttaggagcttatagggaaggcaggaggaagaatgtaggaaacttaggggagagcaaatgacttttgggaaagatgaccagacccttaggagaatagatgatagtttgtggcagtctgtcttagtgtggtatggacccttagtcttgtctcctgtgatatgaggagtcgattttccctggctgatgaaactcctaggaaggagatgaatgtctttgtgctgacaagacagtatcttgaagttttgatttccaattccgttctaaatctgcagtgtataaaaatctcctcatcatgctttggatgttatggtagataaatggtatctttacaaagatacattcattctggtattgaaagttccttttggaggatctctcttgaggaacgtaaagggagtgcagagaaagcatgtctcgcatttgttgtttttcaaatattttcagttcgatgtaatcagtacaccaaagcaatccatttaggactggcatttcctgaacaccttcagaactctttttatcccatgttatttctatgagatcacgtgatttaagaataacttttacttgccacttacatatatattgaaaaggtaaactttcctttcgtagtttgctaattttggcaaagtactttaacaaaagttaaattaaatgagtaagtgaaattttctgttctattgttttgaaaacaattctagaaactctccttgtaagaacagcaaaaagagaaaaagataattctcaactgctgcttcaaccattctttgcttaacaattagttaattaaaaggcaaaactctatttcaggtttatatgtgtcaattgcttgattagaaagtaaattatttaccacatataatctggtgtcaaaaaacttataataaaattactttgattttattgcttataagtttgtgaatttaaatctcaacttacagtgatgaatttatttgctttgtgctgacaagacagtatcttgaagttttgttttccaactcagttctaaatctgcagtgtatcaaaatctcctcattatgctttggatgttatgggacataaatggtatcttcacaaagatacattcattctggtactgaaagtgcccacctaaaattctgcatgaacagttttattgaaaaaatatgtagacaagccattaattatacacagtgatttagaacaaattcttacaagaagcatagcatgtcttccattaactgtatacaattttaaaaagttactgaaagtcttcctgaagttaaacaataaatctttaaatttaaccactgtgctccctcaaaggtaattttttctttatgacactcacttaggggatacagtcagatctcagcctactttaaacaactaggcagtatttttagtgcacttttctgtttgttaaaaagctagttgtcaacgttagcaccagagttggggagttttaagaggtttagaagcctagccatgaatacccacaacagttacggaggcaaaggaaataggcctttgaaaagaagataatgccctctccctctccccacgttcccctctctctctctttccacggtctccctctccctctctttccacggtctccctctgatgcccagccgaagctggactgtactgctgccattttgactcactgcaacctccctgcctgattctcctgcctcagcctgccgagtgcctgcaattgcgggcgtgcgccgccacacctgactggttttcgtatttttttggtggagacggggtttcgctgtgttggccgggctggtccccagctcctaactgcgagtgatccgccagcctcggcctcccgaggtgccgggattgcagacagagtctcgttcactcagtgctcaatggtgcccaggctggagtgcagtggtgtgatctctgctcgctacaacctccaccttccagctgcctgccttggcctcccaacgtgccgagattgcagcctctgcccggctgccaccccgtctgggaagtgaggagcatctgcctggccgcccatcgtctgggatgtgaggagcccctctgcctggctgcccagtctggaaagtgaggagcatctctgcccggccgccatcccatctaggaagtgaggagcgtctctgcctggccgcccatcgtccgagatgtggggagcacctctgcccggccgcgaccctgtctgggaggtgaggagcgtctctgcccggccgccccatctgagaagtgaggagcgtctccgctcggcagccaccccgtccgggagggaggtgggggtcagcccacgcccggccggccgccccgtctgggagggaggtggggggtcagcgcccgcccggccagctgccccgtccgttaggtgaggggtgcctctgcccggccgcccctactgggaagtgaggagcccctctgcccagccaccaccccgtctgggaggtgtacccaacagctcattgagaacaggccatcatgacaatggcggttttgtggaatagaaaagggggaaaggtggggaaaagattgagaaatcggatggtcgctgtgtctgtgtagaaagaagtagacatgggagacttttcattttgttctgtactaagaaaaattcttctgccttgtgatcctgttgatctatgaccttacccccaaccctgtgctctctgaaacatgtgctgtgtccactcagggttaaattgattaagggtggtgcaagatgtgctttgttaaacagatgcttgaaggcagtatgctcgttaagagtcatcaccactccctaatctcaagtacccagggacacaaacactgtggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaaaagctagttgtcaagaataagttgctcaaatatcttcctcaattactttttattttgttttgtaattattattctattttggttttcctttagaattgtgaaatatcttgaatcagaaattgcagagaatatataaatgtgtaggaatgtactctgcaatcaaactagatctcgaaagtgttttgttgtagtttataccttgaattcgaaggccattctatacaaggcacttgaaaaattttcaagctcatatatttcataatagtacagaatttattgttcttttatttgcaaggagatagaccagataaaatatcactttattttttacagtgttgactttgatattctaaacttgtcagtttatacagattaatgaagactccgtacatgtaaaattcactataattttttttctggtatgagaatacaaacaaatagtaactacataaccaaacaggtaaagtaaaaatatacaatagcttgacaaaaaaaaaaagaagaagaaaaaagaaacccctatacattccttaacattctaaatctctgaggacaaaattggattcaaaagaaacatttctcgtgggcagggaaagggctaaaaatctaaagtatataataagtaaattcctcattgctataaaatatatgaccagcatgacatttcaatgcatgttcaagttttctgaagaaagttctaggataataggatttcaacttttgattctacagatatcattcttgtgattggtatgggagaatcatcctctccatgtattagtggattcaaatgaaaaaaaaaaaaatcaggcagctagttcctttccaagaagccttagagattgttgtacataaaaatagccatatttctgattcaaattttaattagagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctgcctgcctcagccttccaaagtgctaggattacaggcatgaagcactgtgcccggcctttttctttttcttttgttttctttttctttttctttttttttttttttagagcagcatcacttgctctgtcacccaggctggagtgtagtggcgcgatctccacatgctacaacctccactcccaggttcaagagattctcctgcctcagcctcctgagtagctgggattacaggcgtctacatcacacccagctaattttttttgtatttttagtagagatggggtttctccatgttggccaggctggtttcaaactcctgacctcaggtgatccgcctgcctcagcctcccaaagtgcaaggattacaggcgtgagccaccacgtctggcctgcagtggttttcttactactttttacaatcaaattgattaaggcattggttgaatatggtacaatacatccatttcaagtttgatgacatgtctactactccagaaggtcctcttgtgccctttgcagtcagtcccctcgactccctgaccccagcaattaatgatgtattttctgccactatacaggttagtttcacctgttccagaaattcaccttgatggcaccacacagaatgcactcttttgagattcacccatgttatctcatgtttccataatttgtcccatcttactgagggtggtattccattggatgaatatatcacaaaaggtccattaacctcttgatacatatgaactgtttccagtttggggactattgtaaacaaagctgctaagaacaagttctttttgttaatatttgttttgtaaattccgtttgtcattctttagtattaacttattttgtaaaaggacgtaatcttcataagtgcaaaattcattcaaattttacagaggcctgaagcagaagcctacacaatttcctttgttatatttcataattaagggggaaaaaactttatctgggatgttgtttcctatcagcaaatccttaatgtaagccatacaggatgctagctgtactattagactatcttctgtaatctgtgcaataactctaagaagtacttcgtcttattattttcctgtaacactttccaacttgaagcctagcaaattgaaggacctggccccaggtcaaacagaaggcaagcggcagcgccagtactggaagaaggccttcccaaaggcagacagaagctcacgtctttgtcagaacctcggtatttctgatgcgcctggaagccaatatccaagccgttctcagccactggattggtgggctgctttgctcagaaactcctcgatcaggaatcccaagcatacgttagtgatgacggtcccaaaacaagggacatttcttaaccattctaaaaacccgtttgctcattagtaacgcaatgaaagttgctttcgtcttggttcatatattttatatttgagcaaggcaatgtccgctgctggggttagaagtaaatggctcgtcttcatcaaactagatcagtccgtaggacgtatggcttccactcgcagtgtcctgaacactggctgggcttcctgtgcgttctagccggttttctttggagccgcgggtttctgcaccgcaccctagtcgggatggcagaggcttctcggaacacgcggatctatgagtgcagtccccggggtagccaccagggaacgccataggctttcccgctgtgttcctccttgccttttccgtttgggccaggtagtttctattgaccaggacattacagatcagaagtgggtggggtcagaaaacacaccctgggagaggctggcaaaatgcccagaaccgccatcactaggactggggttttcttctgtagtggaattctcgtgttcatgtagtgcagggaggatcgcagcgcatttccgccaagacaagtgagactgcggttctgacctgcgggcctcgatgaattgcgttaggacacctgggcgctggcagagccgttctcctacacaaagcaagcgtgttatgtctacaaccgaatggggacactaagagccccaaaggccctgctttcatcccaaagaagagtgcctgtctgcgtagtttccacctggctctatgaggtgagaactgattcctcgctagcacagaaatcctgaaacagaggctgtgtaaaaggtgacaggggcctaggggaaaacacgaagattttcacagagcgtgagaccccaagagactggagaccatggatcaatttttgcaataagcagccttatgttcaaagggaaaagctatgcagccttcgcgctagttaacttgtgataaacaggctcacaacggctgacgcttgttccttctccagcgaggacaacgacatgccacttctgttccccagccatccaactgtaaaaataacatgacaccacccatattatgcactactaaaagtatcccttcacatacaatctgcgttttccagcacaaaattcagaggacagcgcgaacgcagtcccccactaccacaaattatgcagtcgagtttcccacatttggggaaacggcaggggtcagcacatccggagtgcaatggataagcctctccctgggaaaaccaccttcgtgatcatcgtatctcccctgccaggtaagtatgagatcatacgcctccgccctgccacagctccatacgcctcaccccttacacgcacggtcacttcccacgcgcaaccccccaccgccccccacccccacccccagccctcctagccctgacacacagctgggactatcacgtccaaccggcggtcctggacttgctcccacagcaggagaaatcctccgtggcgaagcagcagcccctgagatgcctcatctacacaggaatcgccctatccgtgatgtcaccgacagcacctttcccggtccggctctgctcttctgccccaccctctgccacctcagccgatgaacccgctgcgggagccggcggaggaagtgacgcctgcctctccctcttttccctcccatccacgcccctggtctctcccagagaagtaggttcttagtctgtgatgccaaggacccctttggcggccagctggagcctgtgcgctcttcttcaaataatgtcttttaatgcgcaaactagaaagttcaggattacaaagaaaactggttcttttcacatacggttatccttgtgatgtagcattccgcttgacattggaagtcgttcgatatcagagagaaaccatatctacgaaactagagaggctgctcagatgactacaaaccagccattcttacttgttttatcactgggagtgttataaagatggtcgtccagtttcatgattcttgcagggttttttcaaatacagcaatgtacaaaaatgtgctgctccagcagagcacactggacacgcagacatggtgccggagtttgccatctcttccactgccttctctagaccttggcgcttacctcatgttaacagtttatatgctgcaaagacagaaacaaagtcatccaaatttggcaaaaatatttgggggaaattttatttcaggtgtttaactgattacttttaatatgtagactacaacaccaaactctgacaatactccacagacttattaatggtttccacccccctctctgcaaatctatcaggcaagtttttcctgcccttcactttcatataagctgagtcatacagtgtgtagtgggttttgtggggagtgttactgcccaacatgttcaccttgcctgctgcctagacagagccaatttttcgacacaggggaattgcaataaagacctgcactttttatttggtggttgggggccagtgagttgagagttgtgattggtcaggtcggagatgaagtcacagggagctgaagctgtggtcttctgctgggtcagttcctgcgtgggggccacaagaccagatgagccaggttatcagtctagctggtgccagctgatccactgagtgcagggtcggcaaaatatctcaagcactgatcttaggttttccaataacgatgtgatctccaggaacaatttggggaggtttagaatcttgcagccagaggctacatgactcctaaaccataatttctaatctcagggctactttgttagtcctgcaaaggcagtctagtccccaggcaggaagggggtttgctttgggaaaatgatattatcatctttgtttcacagctaaaccataaactaatttcctcccaaagttatttcggcctgtgcccagcaatcaacaaggacagcttggacgttagaaacaagatggaatcagttaggtcagatctctttcactgtgataattgtcccagttgtaacttttgcaaaggcggtttcagaagcagaggcataggtttgacttctttcactcagtcttatgtctatgaatttttcatgttattcatatggttatttgtttctatgtgtattcctttgtaggaatatacactaacttatttatttcttctgctattgttgagcatgttgacctaaaagaaagaggctgaagcacaaaatataatttagagtttacctgagccaacatgaagagagctgcctggaagactcacactcaaggaaccttggatctgagctccctttgatctttgtcacaagcaggtatttaaaggtcaaaagcagggacagacagtgggctgacagaaaggtgcctgtcaggagttctcattggtttacagaaataacattgattggtgattggctatatgttgttaagttatagggtatgggggtacagggattggtgtggcattattaggttaatttacagctacttgaggcaatagcaagcagtttcaacagatgaatacatagctcagtgcagctcaaaaggaaggagcagaaagtggttgctgtctcgatttaacctctctctgggcctgatcatctgagagggctcacattcctcagataaaacatttttaaaaaactttcttcttgaaagcattgatgatcaaaagctcattcaaggtgtccctctttgccagaaaggcttattcctggatagtcctgtcccaggcaggggacaggggaggaaagaagccacctcactgaggaatttttaagaatgcccaaaagtccaattgaaagggcattacaaccaggcacggtggctcacatctgtaatcccagcacttcaggaggccaagatgggtggattgcttgagtccaggagttcgagaccagcctaggcaacatggcaaaaccccatctctacaaaaaacacaaaaaatagccaggtgtagtggcacacaccttagtcccagctactcaggaggctgatgtaggaggattgcttgagcctgggagttcaaggctgcactgagctaagatcacaccactgcactccagcccaggtgacagagtgagactcggtctcaaaaaaaaaaaaaaaaaaaaaagagagacagagaggcctcagttaagtctgcagcttctgtcacttgttgaatcatctctagtcttcagaataccatgaaattagttttctcagaagtaaaacgatgagaaatacataacaataatgacattgcacttcatcattccatttcctaagacatttatagggccatggatggtgatcttttcaagagacaaaaataaacgcgggtgcagaacaggtaagtgcactataatttgagtacatcagcttttgggcattaaaatcgtgggtcagaaatttagagcaagagggcaggctggatcctgatagcaggagagtgtgtgtgtgtgtgtgtgtgtgtgtgtgttttgagacggaatctcactctgtcgcccatgctggagtgcagtggcacaatctcggctcactgcaagctccgcctcccaggttgacgccacactgagattccctagtagctgggactacaggcgcctgccaccatgcccggctaattttttgtatttttagtagagacggggtttcaccgtgttagccagggtggtcgcgatctcctgaccttgtgatctgcccgcctctgcctcccaaagtgctgggattacaggcttgagccaccgcgactgtccgagtgtttttcttttaactttccagtagcatcatggtgtttaccactgttatttcagagtgaagtgacaattttgttgtttggttggttttgtactttttatttttattataattactttttaagtcaaggactctgtctcccaggctggagtgcagtggcaaggtcacagctcagtgcagccttgacctctagacctccaaggctcaatggctcagcctcccaagcagctgggactacaggcacacatcaccacacccagcttatttattttttgagacagggtctcactctgttatccaggctggagtgcagtgacatcatcagggttcactgcaggctcgaactcctgagctcaagtcatcctcttacctcatgctcctgagtagctggactacaggtggacaccaccacacccagctaatttgtatatattttacaaagtcagtgtttcaccattttgcccaggctagtctcaaactcctgggctcaagtaaccctcctgccttggcctcccaaagtgctgggattacaggcagttattttgacaatacgattatgatggttaaactgagacgtgtgccaggaaggttagggtgactcagacagattagataaacaggttttgcttgatatgaccctgagttgcatcgtgagtgcaatcaggaggaatacaggtgaaatttagcacaggatgtaccaatgggtcattacggtcaaaagtggtttgtggttctgagtggcaaacctggaaccttgtcaaatttcccacagaggtaatggtttgtgagattctgatcagagaattatccctccctgctgtaatcaaattagttagggacagtaaaacagaaatctgatcataagtattttgctatgtatgtatgtatatgtatatacacatacacacaataggactagtgtggcatatcttaagagaatatgcatatagggtgattttaccaaaaccaccaagagacaacccctacaacttaaaggagccctaatggtgtgtgtattccagtcaacaaaaaagagactaactctttcaggtgcagtgagcactggaattgtaactgattatacaggccagtatcttgggtgaaagcggactaccacagatgtcagctacttgccatctctgtcaggaagattgagttacctttaagtgaaaatctcctgacagatgttcactctggcagggttgccttttacaagagaaacatgaatccgtgtgtcaacgcacgtaagtttaatggcacagattggtcagtaatacctgttgtgagtcaggtgcagtggcccatgcctgtggtcccaactatttggaaggttgaagcagaaggatggcttgaacccaggagttcaaggctacattgagtcatgattgtgccactgcattctggcttggggaatagaatgggatcccatctcaaaaaaatgtataaaataataataatacctgatgtggtcccttccaacagtcttggggggaatattttatttggtgttgtttctagtaaacaacatctccaggttataggccgtgatttttagtattttcatctcccaggagtgcattatgaaaggaatcctttattaatgtggagttcttagtaagttttgagagatcttagcagtaatggagaaagtcacctttaagaagtgcagattcataagcgccttcatctaaccactgcatgggtcttccgttattatttcaaagagagggagtgtggacattttccagaaccagtgggagatccttggccaagaaaggttaaaaacttctgttagctttgccaactgagtttttattgtgtcattagtacattccatcggcccagaggattatgggtgacaggcacaatggaaatgttgggacataggcaaaacattacaaatggatccaattacctgaccaatgaagtgtgttcctcagttgctatggcattcagatggcactccccatgaggaattaccttttcttttctttttttttttgagatggagactagctctattggaaggctggagtgcagtggcacgatctcagctcactgcaacttccgcctcccagattcaagcaattctcctgcctcagcctcctgagtagctgggactacaggtgtgcaccaccacgcctggctaatttttgtatttttagtagagacggggtttcaccatgttggccaggatggtctcgatctcttgacctcgtgatctgcccaccttggcctcccaaagtgctgggattacaggggtgagccactacgcccagccaggaattaccttttctaatcacaatctacctactacttgggctgtggctcattggcatggaaatgctcaccccagtgagcacgtacaaattaacaccagaaagtatctgtgaccctgagatggagacagctggataaagtctaactgccatgtctcgaagggtcctaaagttaaaatgtccttgtgacccatgaaggggctttccagggtgatgtttgggacaaacagtaccacaagaataaaccttttctgcaatcataggcaatgattttcaataccattgctttccccatgctaacattttatctgatttccaatgaggcagcttatgaagtactgtattcagggtaattgaagcctaaggggtggatcagtgtatcattgggcccataccataagcctgtttctggaagaaacttgttccctttatccttccagagatccctctcctgcttaggagctcccacttacgcttctttttttttttgctagagtctagctgtgttacccaggctggagtgcagtggagcaatctcggctcactgcaaactctgcctcccaggttcaagcaattctcgtgcctctgcctctcaagtagcaggaattgtaggcatgtgtcaccacaccagctaatttttgtatttttagtagaaacagggtttcatcatgttggccaggctggtctcaaactcctcacctcaagtgatccaccagcctgggccgcccaaagtgctgggattacaggcatgagccaccatgtccagcccacttttacttctaatgaagtcttcaatgggtcataagtcagcaaggtcatttcgagaagttctgtgtctgatgccaccttcagaactgcattcttagctgcagcatcagcaaaatgattgtccttgctctccggaatatctagttttgaatgaccaggaattttgatgatggccaaagataagggttttcaaattgcttctaagagatcagagatttattggtcatttttgatggcttgacctgatgaaatcagatacctatgttgcttctaaagcattccaaaatcatcacctactccaaatgcatctctgctcccagtgtaaatgttaggctgaggtggaaggattgattgagcccaggagttcattcaggtccagcctggaaaacacagcaagatgtcctctctacaaaaaaaaaaaaaaaaaaatcaaagaatttgctgggcattgtggcatgcacctgtggtcccagctactcgggaggctgaggtgggagtattgctagagctgagaggttgaggatgtggtgggccatgatggagccactgcattccagcctgggtgacagagtgagaccctgtctcaataaatcaataaataaatcttaaccatttaaaatatcaatgacagatttgtttggccttttaagtgcattgctgaattctccaatctacatattggggaacaacctgggtaatggcaacatggaggtatttggcaaaaatgcagaccctttcattgtctgcttctgtctgtttttaaaaaccctctaaaggattattccaattcaccctttccaaccatttagtggccctgccttcttacaccaacatgtgaattaattgataaagatcagaatatccaggctcaaaagtttggacaattaagtcaaattttctcctaaaccctataggatcttggaggttgcttttgaattagaaagggaaaattcagctgggtgcagtggctcacgcctgtcatcccagcactttgggaggccaaggcgggtggatcacaaggtcaggagttcaagaccagtctggccaagatggtgaaaccccctctctactaaaaatacaaaaaaattagccaggcatggtggtgggcacctgtaatcccagccacttgggaggctgaggcagagaattgcttgaacccgggaggcggaggttgcactgagcagagaaaaaaaaaaagaaagaaagaaagaaggggaaaattcatgtaaattttcatcagggaagtctttttttttttttttttttttttttgatacagagtcttgctgtgtcacccaggctgagtgcaatggcatagtcttggctcactgcaacctccacttcccaagttcaagagattctcctgcctcagcctcccgagtagctgggattgcagtcatgtgccaccatgactggctaatttttgtatttttagtatagatggggtttcaccatgttgtccaggctgctctcaaactcctgacctcatgatctgcctgcctagtcctcccaatgtgctgggattacacgcaagagccactgcgcccagcccagggaagtctttttataatattcttaattcacattttggtgaagcagtatacagaatggtaggctcccctcttcctgtgggttttaccttgaaaggggctgtcagaacagaagtttcagggaaggggccagagccctggggactttcctcaggtgatggtgatggaagaagaggcaaggcaggaccagagggctcaggtaagggagactatgcaggtgcaggggcaggaggagaagcagcagttggaggcgaaagagacaaagcctcctcaatatttctcaattcagaaaacgtgtcagatgacttccttcagcttacttcctcactggaggcaattttctcagttcttttagaaatttctaggtatcattggaagtatgtctcccatttaatttggttctaaaaccaaattttttggccaggcgcggtggctcatgcctgtaattccagcactttgggaggctgaggtgggtggatcacgaggtcatgagatggagaccatcttggccaacatggtgaaaccctgcctctactaaaaatacaaaaattagctgggcatgctggcgtgtccctttagtcccagctgtttgggaggctgaggcaggagaatcgcttgaacctgggaggcggaggttgcagtgagccgagatcatgccgctgccttccagcctgggtgacacagcaagactccatcaaaaaaacaaaaaacaaaaaaacaaaaacaaaaattttccaattgtgcacactaataaattattttaagcatttcaaaagatcccaattttcttcattctgcttatgacttaggaaatgaccaggaaatggttaggtgggtccagtttcttggatatttacaagaggatgcttcataagtgttatacataaacccagctggtgtttctaaaggtggttgtttcttcacagtgtgctgaattttgaagcttgatttcccataattcaggagcttttcagatgaccaaggcctgcgatgtgttttgggtcacagtgtggtgcttatgaagtcactcctacagataacaccggagttgtgtgtcactgtctcagtggttccactgtttctaaccaccaggtggccacagagtcccacatatatcctcccagaagagcaggaaagggggttgataaaagtgttcttctgatgggaagtgtcctataaggccaccttcacatggtgactaatgaccccaacacctctgcaacatccccgatcacttggagcacctgaatggatcagcgggagcagatcacttcttttcttcagggcaggggaacacacctccatgcactttccagttaagaactaacaggaattagtcacaaatgaaaacctaagtccaaatgttcaaaacaacatgctacataaaacaaaaccaccagggcctacctgccaataccttgacccagaacttcctgctgaggaatagaggcagaaaaggcagaagctctctggggagctctttgcctgactgtgacccaaaccttctgtcctgatgcagaggtggaaaaggcagttatttccccctgaaacacaaatctcttacccacagggtaaagacagaaaacctctgttctagaaagggagagctgaaaaggacactcaagcaaactccaagacttcaatcaaccagtgtttctctcagagtcagtactcgaaggcttcagagctggccaggcacccagtccaggaggaatgtggtgtgatctgagagatgaaaatacatgcccccttatagactaagacagactgtaaggttaaggaaacaaaagttagctacttgtccagggttcagggctcatctggcatggcaacttcctgaattcctatggctacaggaaaaaccacactcttgctaaactccttaacaataggagctagcaagcaaattgtcaaaatcttcccagcccttctcaactggatttacaagccagatcactagagctctgatgggacagaggagtggccttccattctttcctaataagcaactgcagatatcaagccagtttcagccatgttacagggactgcacacaaaccaacttcgtgtccagtagttcaccttttgatataaagagccaatttctgccttattttatgctaaaatcccttccccatctgtgaagatggggtgcatgttacatatatgtttacccattgcacatgagctcaatactcctcagaaatggtgtttccccaaacctactgaatatgtatgactctattgtgtgatacacaccctgtgaggcacaaaaaccaacctgccctctctctctgtctctgaagagaaagtgcctcttcaaagacacacaccggagactgtcacttcctggactgcaaacttatatcaccaataaaattcttactactatttagccaccctggaggactttgagaggacagtcagatggtcagagatgagtcagtctgaatcctgctcccagggccaaaaacattgacatagaaggaaggcgcttaagcacaaaatatgatttaaagagtttgtttgagccaatgtgaatgtagttgcccggaaggctcagacccaaacaatattggatatcggttctatttggcctttgttacaagcaggtttgtaaagaccaaaaagggagtcagggagttggctggtaaaaagttgcttgtcaggaactcccagtggtttacagaaataacattgattagctatacattgttcagctacagggagtgagagatggtgtccagagcagcatgtttaggttactttatagctaactgtggcaatagcaagcagtttcagtggatgcatacatagctcaaaagtggggaagtggccggtggtggtggctcatgcctgtaattccaacactttgggaggccgaggttggcggatcacctgaggttaggagtttgagaccagcctggccaacatgaggaaatcccatctctactaaaaaaaaaaaaggcaggcgtggtggttcgcgacgttagtcccagcaactcgggaggctgtggcaggagaattgcttgaacctggctggaggaggttgcagtgggccaagatcctgccactgaactccaacctgggcaacagagtgagactccatctcaatacaataaaaaaaatattttttaacttaaaaaaatttagaaagcaggaagtaggatgtggttgctctctcattttaatgcctagctttaggcatgctaaattgaaagcactcattttcctcacatgaaaaattcttttcttttctttctttcttttttttttttttttttggagacacactctcactgtgccacccatgctaaagtgaagtggcatgatctctgctcactgcaacctccacctccagggatcaagcaattctcatgcctcagcctcccgagtagctgggattacaggcgctaggcaccatgcctggctaatttttgaattttagtagagatggggtttcaccatgttggccaggctggtctcgaactcctgacctcagatgatccacccgcctcagcatcacaaagtgctaggattacaggtgtgagccaccatgcccagccaagaccattaatttaatctatagctaaatctattcgtttttcatgttacaaattcaacaagaaaaattttccctaatgaaacatcacatttaaagctaagtagaaaaaaaatgtaatagtgccttgctgtgtcatccaggtgagagtgcactgatgtaaccacagctgaccagcctagaactctgggctcaggcagtcctcccagctcagcccgccttctaattttttagagacggcatcttgccctgttgcccaggctggtctccaactccttgcctaaagcattcctcccacctcagcctcctgattttctgggattacaggtgtgagtcaaccagcctggcattgcaggaaaaaaaaagcccataaattattctttattttattttattttgagttgaggtcttactctgtcacccaggctggagtgtggtgttacaatcatagttcactgcagcctggatctcctgggctcaagcgatcctcctgcctcagcctcccaagcagctgagactacagacatgagccactgtgctggctagtttttttaaattagttcattttttaaaatttgtagagacaggggtctcaccatgtttcccaggctggtatcaaactcctggcttcaatccttcttctctcctcagctgcctaaaatgctaagattacaggtgtgagccaccacaccctgcttaatttccatattttaattttatatatgtaattattactgtctttaagataattggggcagtaatctctttaaagctttagggacttaatttatctattcactccactggaagagtatgacaattggtttcataagaaaaaaatttataaattagaaaatttctttccaccaatctagggggcattcaaaagcaaataattgcgttaagtaacatcatttaaggtgaaaacagatgcagtggtatctattaatgcttatcagtaagggaaacaaactgaaaaaatgaacatcattagatccttggaaaaccctcattgctgaaaatctgagtgattctgggatacccttttgagtctggcagggcattctctttccggagcatataaaagtgagtaaatcattttttttaatccattttcattaagagctgaacttccttaattttctggagattattaaatttgatttgtggccaggagcagtggcttacgcatgtaatcctagcactttgggaggccaaggtgggcagatcacttgagttcaggagttcaaggccagcctggccaacgtggcgaaaccccatctctactaaaaatacaaaaattagccaggcatggtgttgcatccctgtaatcccagctactcaggaggctgatgcacaagaatcgcttgaacccgggaggccaaggctgcagtgagccaagatcgtgccactgcactccagccttggtgacagagcatgactctgtcttaagcaaaaaaaattttgatttgtagagtttagagaagtgcttatgttgctgactccattgcttatttgtgatcatataaatctcttttctcctttctgtagtgtgatttaaacgtaatccttaaaggacatatatttcagctggttagagttttttagctggtagaaaactgagtgtatgaatcaaagaaaactgctcctttcatgctacagacttagttttatttctgtactaagatttcttttaggtatagtaatctgttaaagccaagagctcctatggaatgaagttcagtggcgggttacggggggcattgagtagtaagatcatctttataatagagatgccactcttgcaaatattgacagctattgagcccaaaaaattgttaccaaacattggaaagacaagatatgagcaacttctcattgctgcagtctcaaatatcaggaaataccattatcctcaggacaatgaacagaccatcaaaagagactcacagaccagatcagctctcatatatcaccaaacagggactggatccttgtcaaacaccacctaacagagattgtccccagaaattcacttcataacatcaaaaccagaaacccacactgatgccactgatggcagaaaacagtgatggaagaaagagagagagggagatagagaaaggaaggacttgctcaatgaccatacttagtatataaaaagcaaaacagctcaacttctgctcatgaaaacaagaaccaagggaacaagagccaatatctctaaggatccaggtctgcaccaggggcctgttaggtgcaggattctgttggctccaatgatgggtgtcagatggattaatttttatggacatagcctctgaaagaaatccgtcgaggctaataatacggagacacttgtctgcatgctcattctccattaatatagaaggaaactggcattagattgttttcatcaaataaaagtaaaatcaagatttataaagagaagaggaaaggggaggagaaaaaaaatgactgggaccattgtgattttgctccctttggataagcaacttggcagaaagctatcaaagaggtcactgtgacctgtcttctctggaccaatgtgacttggtcatcacaggaaacaattacaggctgggcacagtggctcatgcctgtaatatcaacactttgggaggctgaggtgggtggatctcttgagctcacaagttggagagcagcctgggcaacatgatgaaactctgtctgtacaaaaaatacaaaatttagccaggcatggtggtgtatgctagtagtcccagctactcaggagtctgaggtgggaggatcacctgagcctggggaggttgaagctgctgtgaaccatgattaaaccactgcactccagcctggatgacggagtaaaaccatgtctctaaataaataaattaaatttgaaaaagaaacagggccaggcatggtggctcacacatataatcccagcactctgggaggccaagatgagagtatcacttgagctcaggagttcaataccagcctaggcaacatagtgagaactcatctctaaaaaatacatatttcttaataaatatatacaataaaatatataccatattttattatacataatatataattgtatgtatttattatcttaataatatgtatatatttattaaatatataaaataaaaaagaaacaattacagacgttggaggactttaaaatatctcagccaggtgcagtggttcaggctggtaatcccagcactttgggagactgaggcaggaggatcacttgagcccaggaggctgaggctacagtgaactatgatcgtgccattgcactgcaacctgggcaacagaacaagaccctatctcaaaaaataaaataaaatgtcttagaagtttagctgtccatcctatgcaactgaatatctgtgtgtaatgtccaccatgtccttctgtttaacctcccccttacttaagccagaaaggcatttgtccccttattagaatatcattggcacatggctgggggtggtggctcatgactgtaataccagcatgttgggaggctggtcaggagtttgagaccagcctggccaacatgatgaaaccttgtctctactaaaattacaaaaattagccgggcgtggtggtgcaggcttgtaagctgagatcacgccactgcactccagcctgggtgacagagcaagactttgtctcaaaaaaaaaaaggggggggggaagaaaagaatatcatgggcacatgtatagaaagtttgttaggctgggtgcagtggttcacacctgaaatcccagcactttgggaggacgaggcagatgaatctcttcagcccagaagttggagttcctggggccaacctgggcaacatatcaagaccctatctctaaaaataaaaaaaaaaagttggatttgatggtgcacacctgtagttccagctcttctggaggatcactagtgccatggttgcaggggcggtgagtttgcagtgacatgagatcatgccactgcactccatcttgggtgatagagtgacacctagtctcaaaacaaaaagtacgggaggggagaaaatttgttgtgtcagcaagtaaatgaagaaagggacattattagagttgagaaataaactggaatgtgatttggtacctctcccgcagaagataagtttgctaaatgtgctgaaattagaagcattgtataaggccctgtgcagtggctcatgcctgtaatcctagcactttgggagacctcggaggtgcccgagctcaggagtttggggaccagcatgggcaacataatgaaaccctttctctacaaaaaatacaaaagttagctaggccttttggatgcgacaactgattgtgccacagagacacaaccctagtggcttaggactctgggaagatataatctccgccgtttatctagtgattgataatgcatgaacgctttaaaagctgaagcaggcagccgggcagggcgcggttgcttacacctgtaatcccagcactttgggaggccaaggcgggtggatcacgaggtcagctgatcgagaccatcctggccaataaggtgaaacctctgtctctactaaaatacaaaacattagccgggcggggtggcgctcgcctgtattctcagctactcgggaggctgaggcaggggaatcgcttgaaccagggaggcggatgttgcagtgagccgagatcgcgccactgcactccagcctggcgacagagcaagactctgtctcagaaaaaaaaaaaaaaaaatctggaggaggcatccctcagtgggctctaaccaccaacctctagattaacagccgaacgcgctaaccgattgtgccacagagacaggtattgtaccttcttctgggcactataggaagggtgcactcaccaaacactcccccaaccgtcccaacctcagagcccaccagacagtacaactgtgcaaggctttggaaaactgaagagattagagtggtgaatcgtgttagtctcattggagacccgcaggttgggagattctggaaccaggacgaccttgcccctcgccttcatcaaaagctgccggaaacgccccggccccgacacagacctgaaccgcctgggggcccaagggaaactgaaaggccggtgggctcccgggatggctcttcccgttctttgcgcctccttcacccagtgagggagcctgtgcccactctgcccagtcacttttgaggccgctgaggaacttccgctgccatcttcggatcctgtgtcccgcacgggggctccaccagggcagggatcgtggtgagggtggctcctgggtcccctcgcggggagcagggtctggcactcaccagcgcgcacgactaggacttgttgaattaatccatcctcgcctttagcttttaggcctttgaagagccctgaaaatggaaatcatgaaatattttaccatggggaacttttgatttgctttttgttgtttgtttgtttgttttgtttgtttttgagacagggtctcgcttggtcgcccaggctggagtgcagtggtgcaaacacggctcactgcagcctcgacctcccggggccgtcgtcgcctttagcttttagtcccttgagaaccccaagaatagaaatcatgagatttttccatggggaagttcttttttcaaagcgtctattcaagttgatttctaggcatcccccagggagggcaacgggcagggcctccagtgcaccttctgcgcggtggagccgcgggggctcagttgggcagtagtagggatcgtggggagggagggcaggagcgggggaagggaaaagcaaaagcaaggaaagaagccggggagcggtggaacacacatccggacctcctgaaaggctggtgcagaggcacaggctggatctggaggtgagaattgttttgttgttgttgttgttgttgttgttgttgttgaagcagaatggggaggaactgaggggaaaattcagagacaacatagaagagcttcaaacgcgaggacctataactccccaagaataacatcttccagggacactagacagaaaactaggcatctgggaaccctgaaatccctggaggagtagcatcatcatgaccctctgtgttccttttggcaaaaggacttgcttcccttgtttgtgcaattgtttgtgtttgttaaataaataaaacccttttcatatatctttgaaagtatattggctctattattttaagattacaaataatgctgcagtcatcattcttgtacacttctcattggccactggtgtgtttctacagggtagaggcttggagagcagttgctccagcatagtgtttacatattttttatatcattccattttctttccttttttggcttattagctgtaactctttttttcttcttgtccaccgctccccgacttcttttcctgctcttgctttttcagtgatggctttagggttttcagaatacatctttatcagtgccgtctagtgacattctacctccccttctggctgttatgttagtgttgttatgtaatttgattttagacatgttataaaccccagaatccattattatttcttttgtttaattggtcaaattattttaaaagatttaaataataagaacatatatatttaactatgtacataccaattgccactagtctccatttctttttgtagatccagatttctgtatggtatccttatccttaggcctggaggaatccttttgcatttcttgtagtgtgggttgctgaattctttttttttgttttgttttgagatggagtctcaccctgtcacccagattggagtgcaatggtgcaatctcggctcactgcaacctctacctcccgatttcaagtgattctcctgcctcagcctcctgagtagctggaattacagacacaccccaccacacccggccaatttttgtatctctggtagagacggggttgcaccatgttggccaggctgggttggccaggctggtctcgaactgctgacctcatgatccgcctgcctcagcctcccacagtgctgggattacaggcatgagccactgcgcccagctagaattctttcattttttttctatgtatttaaatgtcctcattttagtcacattcttgaaagaattttcattttggcatagaattctaggaaaactttatttctttcaacactttaggatgttgccactttgtttttgcaaaactggcataaagtgggcttcttgtacttgttatataatttttggaatgtgtatttaaattaataacataaaatggggtggactgctgggcgcagtgcatcacgcctgtaatcccagcactttgggaggccaaggtgggcggatcacgaggccaggagattgagaccatcctgctaacacagtgaaacccagtctctactaaaaatacaaaaaacttagccgggcgtggtggctggcgcctatagtcccagctactccggaggctgaggcaggagaatggtgtgaacccgggaggcggagcttgcagtgagtggagattgcaccactgcactccagcctgggcgacagagcaagactctgtctcaaaaaaaaaaaaaaaaaaaaacggctggaagaggtggtgcacgcctatagtcccagtactttgagagggggaggcaggaggatcgcttgaggctcagagttggagaccagtgtgggcaagatagcaagaccctgttctctgtctcatgtatatatatatatatatacacacatatacacatacacacacacacacacatacataaatcgtgaatgtcctagattcatcttaagttccaccaacagtacacttaaagtaaaatgtgcccaacctgagggtcaaacctacctgctgacgtgcagtttgtgtttgtgagacattctcaacagcatttgctttccctagcatagtggttttcatgttttcctcacacctgaatgtcttaagtgcaaaacttgtcagaaataatttcctttgccaaaagattctaaaatactttttttttttgagatcagctcactgcaacttccacttcccacgttcacaggattctcctgcctcagcctcatgagtagctgggactgcaggcctgtgccaacacacccagctaatttttgtatttttagtagagatggaattacatcatgttggccaggctggtctcaaactctgtacctcaagtagtgtgcccacctcagcctcccaaagtgttgggattacaggcgtgagccaccatacctggcctaaaatactcttacttcaagtaaaagtgcattaaaaacaaacttctcagttgcatccctggaatctatagaaagcccggggagacaatcaagtgctacaggatcaagcgctaaacaggggaggacaaagtgtggcttcctcactaggagtcagggcaaagttaactgccttggtttccaatggagaccagaactcggttcccctgtgacgggaggacgcagcccagaggaggccgactttctcttcatggtgccttcagacaggaaatctcctaggatttctttctttccctttgatctactcccaatactccctttctgtttcttcaaggtcttttttggatccctactgcacaggacctaaggggctggtgcccttccctaccctccctgcctgggtgtcttcagcacccaagctcacccagaatgttattgcctgccagagacagtgagaggaccaaggagggcagtgggtgcagtagaaccacagcgtcaccatgtacctgtgcctcgtgggatctgagcaaattgaataaacgccccctgaagcttttctgcaggtcacagggaaggggagggtggctgctgacccagcaagagaagcatcaggaagcatcgggggacctcactgtacccctataccttgaagacaggcctggctaggctgattttaatgggtaggccgaaggaaaagtctcaatggcaacccaacccccgaccctgagattacagctttcaaatgtctgattgttttgatgttggtcagtagaatccatcccacctttatcaggagactcctttgccaaaattctgagatctgggattcctgctggttgccgcacagaaagccaatcaccaagatgattattgccaaggaaggcactttaatagggtgctgcagtgggggagatgagaactcaagtctcaaatctatctccctgaccagccaaaaccagaggtttagatggcaggaaagaaatgaacaatgtgtaagaaaacaggaactagggagcagcaaggaagcaatcatgatgaacgaggggtcccagcatctcactgtctggatgaatttcagttctttgatagcttttttgacagtcctgaaagtcatttcctgaggaaggaactcagataaaacaaatattaagtttcaagctttaagaccagaagggtccatttctaggtttatccaaaaaagctacatgtgggactgttgggtggttttcagatcaagaaagaaaaagattgtgcagaccaaagtctgaagttaaccaaagaaaaaacaattttctgaccaataggatgtataggatcagagaatgacaagcctatagaagaactgtttttttgtcctgagcataggggaaggatgaagctgcaccagataaggtggaattaagctgcagatgggcaaaaatctgaattttggttcagagccctggggtcttcctcaaaagtctccttccttgaaagaggaaccctgtcttggtttctgcatctctctgagtccttttggaggttgaggatgctgaggtcttggtgcttggccccctctaaccctgagtacttcccctcctgcagggcaacctggccaagtacccaggccccagctccagcgaccatttccccctactttgctcctagcaaaggctatttctaggtcagtggtgaggcacaggcaggacagggcaactcgttctgacatgttttgccctggaaggccttgagcactgcggtcctgcagaaccactgtctccctcttttggagaaagcagggaggaaatgacctgtgtggagggaatcgagggctacacctgcatggaggagctgaggcaagcagggcagttccagtctgtaaatgtaaaggacatttgtcatccaagaggttgggctgttattattaattttgaattttgtcaaaacaagcttcagggaaattagtcgtcttacttgtaagaaccttacaagacctcccatcttatattccagggagaattgctgcgtattacatgaacacataggtgagactgctgttctgacctgcaggacttgatgccctggcgcaggggcaccagggtaccggcaaagcctttcccatacaaagagcaaggatgttatgtctacaacccatcggcaccagttccaagtacaatttctgctcgactctatggactgagtacacattccccccagcacagaaatcctacaaactcccatgaatgctatagtgaaaagcaggggctggctaggtgtgatggatcacacctgtaatcctagcagtttctaaacttgagtctaggagttggagaccaacctgggcaacatggcaaaacttcaactcttaaaaaaacaacacaaaaaaacaacaaaacaagcacagaaattagccggctgtggtggcttgtgcctgtgctactccaagggctgaggtgggaggattgcttgagtcaaaatgccaccagatacagtgagaccctgtctcagggaaaaaaacaaacaaacaaacaaaaagaggctgtgtaagaggtcaacagaaaaatactaaggttttcaagtggtgttaaaagccagtgggccttggggaccattgagcaatctacaaagcagggaagcctagatccctgagctccacctgccaagtaccaccacagctaatgtgagagacctcccccacagagactgaaatttgcctcccgaggaaacaagtgactacagacatctgtcccaggataataaaaaagaaaacaaggtctcacaaaaacaaaaacagctgaccacaccatacaatcactgagactgagcctgtgactataggtgaagaaaaaaaggctgtctattattcataccatgaaggaccaggggaaagtgcgaacacagtcccctactactgttgtgggaatcaggagaacagagagaccaatgggtggaacaggaggactttattgagtgtactcaggcccagcatattaaaatccaaaggctgagccctgaacaaagacaaggcttggcttttacacacacttctgaaagggggttggctagtttgaatggtgcagtgggaatttgaaggtgcaaaactcacggtgcaggcaagagggcttacagaagcagaacaaaggcagctaatcaaactgtgaccggtcttgcaatgcaagcatagctggtgaccttgcagctgcactgacaggaaatcaggaacttaaaacttgaataataagaaatggtaaggggaaaagagaaggtagtaaagggatttgttgttttttcctcttatccttgctaggggcagactgtgttgagagagtctctggaactaattcctcagggctctggcttttcagacagtgttatcaaggatctgctagggctctatctattgctggccttggagtcagtcaagtactgtgaagctcagttatgcagctgagcttcacacattaggggagataacagagaacagcacatctggagtgcaatggatgagcctcaaccttaggatgaaccactattggtgaccataggatttcccctaccaggtaagtggcagtccacatacctctgccccaccacagctccatacgcctcacctttacacgcatggtcacttgctctgagaaccacccccaccaatccccaaccaccctgagccctcctagccctaacacacagctgggactctcacgtccacccagcagtcctggacttgctcctacagcacgggaaatcctccatggtgaagaagcagccctgtgctacctcatctacatagaaatgccctatcgatgatgtcaccgacaatacctttcttaatgttctggagattattaaattagatttgtatagttgtgaaaagtgctcatattgctgattccattgcttatatgtgatcatataaatcttttctctcctttctgtagtgtggtttaaacttaatccttaaaggacatgtatttgaatttttcagctggttagaaacctgaatataccaatcaaagaaaactgctccttacatgctacagatttggttttcttcctgtactaagatgtcttttagatatagtaaatttgttaaagccaagacttcctatggaacgaagtttgatgggaggggggacattgagtagtaagatcactcttgtaacagggatgccactcttgcagatattgacaactattgggcccataaaatttttaccaaacattggaaagacaagatatgaacaacttatcattgctgcagtctcaaatatcaggaaataccattattctcaggacaataaatagacaataaaaaaagtctcacagagcagattagctgtcatgtattaccaaacagggattggatccttgtcaacaccacccaacagaaattgtccatacaaattcacttcataacatcaaaaccaaaagcccacactgatggcaaaaaataatgacacaataatgagagagagagagagagagagacctgtcctatagccatacttagtgtgtaaaagccaaagagctcaatttctgctcatgatacttaataaaacagacggaacatgagccaataattcagtgggttcagatctgcaccaagtgcctgttggatgcaggattctactgtctccaataatatgtctcagatggcctagtttttttttgttgttttgttttgttttgttttgagacagagtctcgctctgtcgctcaggctgaggtgcaatggcatgatctcagctcactgcaacctctgcctcctgggttcaagcgattttcctgcctcagcctccccagtagttaggattacagacacacaccaccacatccagctttttttgctttttttgctttttttttttttttttttttttttgtatttttagtagagacggagtttcgtcatgttggtcaggctggtctcgaactcctgacctcagttgatcagaagtaggtgaggtcagaaaacataccctgggaaatgctggcacaatgcccagaaccgccatctctaggcctggggttttcttttgtagtggaatactagtattcatgcaatgcagggacaagaccaattagatacttctgggagttaaaaagagatgaatttacagtgccatttgagaaggggtattaaggaatttgccagggtactgacgcgtgtcaggtgcaaactgcaggttgaaagagagctaagtattttctgtccatgaaggtgataagggagggcctgaagaaagacggaccgggaaggacactggcgccagaagtaggaaagggctgcttgggggtgggaaggatgggtcggggtgctatctaaaaagttgcctggcaatggatgtaggatatggaagcgagacatcaaacaagaagttgtcatttaaataaagtctgaagaaagactagatatgtaaacagcaggagataatagggaaactggaccccgctgctcataaaacttcctgccttatatttcagggaggatcgcagcgcatttcagccaagacaagtaagactgcggttctgacctgcgggcctccacgaattgcattagggcacctgggctccgggaaagccattcccctacacaaagtaagcgtgttatgtctgcaaatgaacggggacactaagagccccaaaggccctgctttcatcccaaagaacagcgcctgtctgcgtagtttgtacctggctctatgaggtgagaacacattccccgctagcacagaaatcctacaaactcctgagggggctgcggttagaagcaggggctgtgtaaaaggtgactctgggggctagagaaaaccacgaagattttcacagagcgtgagaacccaagacactggagaccatggaccaatctctgcaaaaagcagccctgcgtagaaagggaagagctgtacggccttcgcgctagtttgtttgtgttaaggctgacgctccctatttctcctcagtgggagaagcgacatcttaattcctatttcccagccttccactgtaagaataacacgtccaagacacaaatcaatgaaagaaaaaagtagcccttagagtacagcgtattcttgaaactacaaaaaatcaggggaaagcgcgaacgcagtaccactaccacaaattatgcaatcgagtttcccacatttggggaaatcgcaggggtcaacacatctggagtgcaatggataagcctcgccctgggaaaaccaccttcgtgatcatgttatctcccctgccaagtaaatatgagctcctgcacctccgccccgtacgcctcaccctttacacgcacggtcgcttgccccgcgcaccccccagccctcctagccctgacacacagctgggactctccggccggaccagcggtcctgagcccgctcccaaggctcgggaactccttcgaggcgaagcagcaggtggggaagcagcagctcctgcgctgcctcatctacatagaagtcgccctatccgtgatgtcaccgacagtgcctttcccaggccccatctgcctttctgccagtcagccgaccaacccgctgcctgaaccagcaagaggaagtgacgtctgcctctccctttttccctcccgccccggcatctgttttcgcccaaagaagctggtccttagcctatcttgtgaagcaaactttcggtggccagatggagcctgggtactcttcttcacataatgacttttatttcgcagactagaacgtttaggactacaaaagaaaccggttttcttcacatacttatccttgtaatgtagcattccgcttgaaattggaagccgttcaatgtcacagagaaaccatatttatgaaagtaaagaggcttctcagatgactgcaaaccagccttccttactgattttatcactggtaatgttataaaaacagttgtcaagtttaatgaatcttgtagttttttttatttttatttttatttttttccaaattcagtattgtggaaaaatatgctgccacagaagaaatgattggacactctcaaatgtggtgttgcactttgtcatcttttgcacagccatctccagaccttattgcttacctcgtgttagttttttatattctgcaaagacaaaaccaaaataatccaaatttgacaaaaatacctgggatacatcttatttgtgatgcttaacaaatgtctggatcatcttttcttatatgggattataatgcaggaaacactgtgaagtaagcaaagttggaattcccaagtcaaagaccatttgaatatttacaagtagatttgagacaggaataatacagggtggtcacaggataacaaattctaggcagcagatttacatgacttgaggctatgggctgataagatgctgaaaaaccagggtgtggaccaagctggctaagactgactggacccaatgtggtgctggatttgacgtaggttttacctaggccctcattatacgcttattaacatactaaatcacacacccaccagtgccatgacagttctgagaccaatatttgatgtaaaaatggatggcaccacagttctgagaaatctccacctttacccaggaattttcatcaatattccactccttggttaaagaaacccattgagatgaaaccccagaacccattgttctctctcaggtatgcccaaactcccctttcttgagtgtgtactttctgctttgcaataaatctcttctttcactatttgctaactcatccttgacctcattcttgagatggtgtcaagagcctggacaccacagctggggtcgagatcctaccagtgtccggggacctcccccagcccaccagtatcagattctattccattgctcaaatcacaaaacatcaaatggagaattcttctttggagaccacaaagtaaagattctgtggcatggtggccagttaggccactggaagacatggcaaaatattgaaaatgagggattaggtgacagcgtagtaactgctgaatgtgaaatacttgatccagaccccattccctgtagactgactgggagacacattgtccaggtagtagtggagaaatactttctgggtatctgaccagcctttgtggaaagaactggcaccatcctgcagatgtaaccacctgatgggttcttcctgcccactgtacacacaaaatcaattcacggagaccatggcattgcagtaaagagtttaactgacacaggctagccatgacatgtaggggacagagttattactcaaatcaatctcactgaaggcttggaggtaagggttttttcaaagacagtttggtggggagggggctagggcttgggcggtgctgattgttggggatgaaatcacaggggtgtggaaaatggccctcctgcattgagtcagcttctgggtgggagctaagggactgattgattttcgggccaaatggtgccatccagtagtcagaaatgcaaaagcctgaaaagacatctcaagaggccaatcttaggttctacaatagtgatgttcttcacagcagtaactggggaagctgcaaatcttgtgacctctggaataatggctggtgattatttaatgaggcatacatcttagtagaattcaggtccctttcatcctcctaacttggtggcctttcattagttttacaggggtaatttagctttggggaaggttatcattttaaccaaactttttggctgtccccagtgtttttggcaccagggactggcttcatggaagacagtttttccatggaagggggtggtggatagtttccggatgaaaccgttccacttcaggtcatcaggcattagttagagtctcataaggagtgcacaatctggatccctcacacgcatagttcccaatagggttcaagctaatatgagcatctaatgctgatgctgatctgacaagaggcagagctcaggtggtaatgctcgaaagcctgcagctcacctcctgccgtttggctgggttcctaacaggccatggaccaatacctgtcttgtggccctgggggtttgggacccctgatttgaactataaactcaatttttcccaaaaatagcttgggagaaattgtgcaggaatgagcaaagacagctagcctgtgaggctagaaccaaaatggagtcagccatgtcagatttctctgattgtcataattttgcaaaagtagtttcagagggactaccctgacacttgttaaaagcatgaggcggattttattgtatgtactacagtaggcaagagagaccagcagagaaccgagctcaactccaaatacagcaagaagggttgaagatttatagccaatcggcaaggtaagaaagtcagtggatggaaaattactaagaggaacttgattaactatcaaaggtggttgggaggactcttgctaaactaggctcaacagtattcttttctaaaactggacttggcaggccaagaactaatagagaaaagggctcagaggaaactgactaaggtttggtcaaagatggagtccttgtcaactctacattgaagtttctgcaaataaacgaagaccaaccaaatgaaaaaaagtaaaggctatttattctgagcttgctatagcagggagtcagccactgttacttgtgttttggcagagacttgaaggcagtcagagaagtgggaaagctttttacaaagaaaggcttcaggtatgcttcaactggaggctgtcagcatgatgaagctagatagatgaaaaaatcaaaatattttaccccagaatatatttctttggcatattttaagatggccgtcagagagccagcaacagaagtaactctgcaaaactgtcttttataggggaaatttacacctacagagaatctgcattaatctagccttcccttgtcaggattgagaaataaaaataagccctaggccctacagccaactgaacagactccctcttggctgacaggaccgcagagaaaccttgaaagctgtttctggctgtggcaggatagaaggctggacatgcccccttaaaacccctccctcactaaccgcggttatgaggcaggagaacagcagagggagttggaagttggataaaaggcagaatgagtaaaagcagaaacagaagtaaggtgatggggtgggagagcaagaagcaagataaaaggcataaactaagcaaccaaaacaaaaagtaagattaaaaaaagcaagcaaggccaggtgcagctgctcacatctgtaatgccagcagtttgggaggccaaggcaggtggatcgcctgaggtcaggagttcgagaccagcctgaccaacatagtgaaaccccttctctactaaaaatacaaaaagaaaaaaatagctgggcatggtggtgcactcctgtgctcccagctactcaggaggctgagacaggagaattgcttgaacccaggaggcagaggttgcagtgagccaagatcatgccactgcactcaagactgggcaacagagcaagaccctgtcttaaaaaaaaaaaataaaacaagcaagcaaggaccccatggccagcaagatccaaaccaataaaggggcagctcttcagagataggcatgtgcattagagagaaaaagtatccttaacatgacttcatatgataatcagctcattaaagctcatgcatatggactgcatatcatgcatgtacttaaaattatgggatagaggcaacattcaagcacacaagggccaaagtaactaagcaacccacctatcaatcaaatggcaaaccctggctaaagattaggcattcttggcctggcacggtggctcaggcctgtaatcccagcactttgcaaggctgaggtgggcagatcatgaggtcaggagatcgagaccaccctggctaacacggtgaaaccccgtctctactaaaaatacaaaaaaattagccgggcgtggtggcgggcgcctgtagtcccagctgctggggaggctgacgcaggagaatggtttgaacccggtaggcagagcttgcggtgagccaggattgtgccactgcactccagcctgggtgacagagcaagactctgtctcaaaaaaaaaaaaaaaagattaggcatccttgtgaagaaaaaaaaaccacacatcaaaagacccaatgtacaccaaactaatactgatctcatctcccagaggtcagcccactctccccactccgagagtgttactgtgcttaataaacttttgctttgctttgctgctttgtgtgtgtcatgtacacttctttgggacaccaacagtctggaactgcacggtaccatctggtaagaattaggcttttttggccgggtgcggtggctcacgcctgtaatcccagcactttgcgaggccgaggcgggcggatcacgagatcaggaaatcgagaccatcctggctaacacggtaaaaccccatctctactaaaaatacaaaaaattagcccgacgtggtggcgggtgcctgtagtcccagctacccaggaggctgaggtgggaggattacttgagcctgggaggtgaaggttgcagtgacccaagcttgcaacactgcacttcagcctgggtgacagaggaatgggccttcactagacactgaacctgctggcaacttgatcttagactgaccatcctccataactgtgagcaataaatttttgttgtttataagttactcactctgtggtattttgttatagcagcacaactggattaagacattaacctgaccttaagaaatcatctcaaatcagtcttggctttgatgagaaacaaagggcacactcgaatgtgtgatttaaagagagttttttttttttttgagatggagtctcgctctgtcccccaggctggagtgcagtggcatgatctcggctcactgcaagctccgactcctgggttcacgccattctcctgcctcagcctccggagtagctgggactacaggcgcccgccaccacacctggctaattttttgtatttttagtagagacggggtttcactgtgttggccaggatggtctcgatctcttgacctcatgatctgcctgcctcggcctcccaaagtgctgggattgcaggcatgcgccactgcacccggcctacagagagttttatgaagagaatatttataaatatatggacaggatcaaaataacgcaagaaaggactgagaggcactcagaatctggaatcatcagagaagttgtattgcctctaggactgaattgttgtataagtctgttcaggttgccataacaaaataccatataccaagtggcctaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcataaggaccccactctcataacctcttttaaacctgattacctctcagaggccccagctgcataaaccatcacactgggggttagggcttcaacatttaagtgtgggagttggtgttcacaattcagtcaattggagtggaaattgaaatgggaaaggaaaactatagttactagagagagctattgtcttggagaggatcactggacaggactatagtctttggagaaataagtgagtgacaactgacaaagattctttctgtgaaaataagtaatttaaaatgtaagttgttggaattccaaattactttgagcctttaaaaaatctgagtatgggccaggcaccatggctcacacctgtaatcccagtactttgggaggcccaaggcaggcagatcacgtgagatcaggagtttgagaccagcctgactaacatggagaaagcccatccctactaaaaatacaaaattaaccgggtgtggtggcgcatgcctgtaatcccagctactcgggaggctgaggcaggagaatcacttgaacctgggaggcagaagttgcagtgagctgagatcgcaccattgcactccagcctgggcaacaagagtaaaactctgtctcaaaaaaaaaaaaaaaaagaaaaaagaaaatgtgggtatggagcctaagtcacatgagaggcacctgtaaactaggcagttgtaacctttgtttctctgattatagattggccttcttccttacatacattttttttttttttttttgagatggagtcttgctctgtgggccaggctggagtgcagtggcatgatctcggctcactgcaaccttagcctcctgggttcatgccattctcttgcctcagcctcccgagtagctgggactataggcgcacaccaccatgcccaggtaattttttgtattttagtagagacggggtttcaccatgttagccaggatggtctccatctcctgacctcatgatccacctgcctcagcctcccaaagtgctgggattacaggcatgagccactgcacccagccacacgcattgttttctaacatgtcatataaattattgaagggtgccagggaagattgcttccctcttcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtaaaatcccatctctagtaaaaatacaaaaaattacctgggcatggtggtgggcacctgtaatcccagatattcaggaggctgagacaggagaatcacttgaaaccaagaggcagaggttgcagtgagccaagatcatgccattgcactccagccttagcaacagagtgagactccatctcagaacaacaacaacaacaaaaaaaaaaaacacaaaaaaacaaaaaattctgcaactaattaatttgttgtaactcttaaagcagccttatatagaaaatgttgtgatcctattaatttttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacactgaattctgaacctttcatttatttcaggttgacatctccttggccaaactctaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcagcccaaaaagggactctttcctgtttattattgcaaagccaatgtatgaaaccaagagtgagtgtcaagcagtgcaggctctattcaatggcattggagaagtaggagcatagcatggaattggagaagtagtatagcttgcaaatcaccttctcggctactgagaaccaggaagttacaaatatagaggatctttaatgaagggaatgagcaaggtgaggaatattcatgcttttcttaggaagggatggagattttcctagaatcaaggagtcacctcatttctgtcctttcttggtctctttcgttcattgtcacagtgattgtcaactgtcatgcactgatgggagtgctatttagcatggaaattggattataataaagctagatgtttttcagaggttgcataagctgccatcatggatttcaccagcttcagctggtttagtcccaagaagaaacttctgaccacagacatcctgtttcttaaaaataagcagagttaaaggtgagtaagaattcagccatgacacatatgcactgcaatggccaacaacatctgggtaggggtccaggtaagtcatgtaggcagtgcaataggtaacacagtcacagaaatacctatgaaaagctgtccttttgtcagggagattagcatgtgtagaggaagtaaacatcaactgcaaatggctttctctgagaccttcttatctgctttatccggatccaggtaagattaactcacaggaaaaggaaacaaaagatctcatgcttttaaacgtctgacagagaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattatttatatatttatttatttatttatttatttatttatttatttatttattttagacagagtcttgttctttcacccaggctggagtgcagtggtgccatctcagctcactgcaagctctgcctcccaggttcatgccattctcctgcctcagcctccctagtagctgggactacaggtgcccgccaccacgcctggctaatttttttgtatttttagtagagacggggtttcactgtgttagccaggatggtctcgatctcttgacctcatgatccacctgcctttgcctcccaaagtgctgggattataggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctacttcttgagagacttcatctgcatcacatctgcatcacaacacagcctttgctcaccatgtctttcctcccctcaacctcccataacctgtggccaccaccccctaagaactccaagcctagttagtcctttttgtgctgcacataaacttcaaccatacggccttctttgaggcttttttttttttttttgagacaaagttttgcttttgttgcccaggctggagtgcaatggcgtgatctcagctcaccgcaacctctgcctcccaggttcaagtgattctcctgcctcagccttccgagtagctgggattacaggcatgtgccaccacaactggttaattgtgtatttttagtagagatggggtttctccatgttggtcaggctggtctcgaactcctaacctcaggtgatcaggatccacccgctttggcctcccgaagtgctgggattacaggtgtgacccactgtgcccggcctgaggctcatatttttatgtgactctgtattagtcagggttctctagacagacagaattaataggatagatatacaaagtagtttattaagtattacacttactttttttgtctttttttttcttactttttgtggaaaacagggtcttgttatattgcccaggcaggtctccaactcctgggctcaagctatcctcccgcctctgcgtctctgagagctgggattacaggtgtgaaccaccacacctggccaggagtttattaagtattaacttacacaatcacaatgtcctgcaataggctgtctgcaagcttaaggagcaggaaagtcagttcaagtctcaaaactgaagaacttggagtctgatgttccagggcaggaagcatccagcacaggagaaagacgtaggctggcaggataggccagtctggccttttcatgattttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacctgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggtccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagaaagggtacaattatctatgttgcaagctagcttaaactaaatttctttgtggagcggggaaggggtagatgagggggcccccaccgatagatgcctggccactgggtgaaagggaaagaaggaaggtggagggggtggctcagtacattctgcttctttatttctttctttccaggtagcctgcctaaacctataccaagccacttagaattgaaaatagataatcacatataggttatttcctactattccctcctttttctttttaccctttttggtgtcattttcacttaaattgctttttcaaactgttccagaattgtttacttttttttttcagatggagttttgctctgttgcccaggctgcagtgcagtggggtgatctcggctcactgcaacctctgccccccaggttcaagcgattctcctgcctcagcctcccgagtagctgagattataggcgcgctgtaatttttgtatttttaatagagacagggtttcaccatgttggccaggctggtcttgaactcctaaactcaggtgatcatgagcacctgcttcagcctcccaaagtgctgggattacaggcgtgagccaccgcgccaagccagaagttgtttactttctttctcataggaggaggagtttatttggtttctaataatagtaggttattttgttggaacatcaggggcatctgtttactgagagttgttttaataaaccttagtgttatatatatatatatacatatatatataaaatatattacatctattatatatagtagtagtgttaaaccccttacacaagtattgatgcaacatcgtatgtcaatgacagaatctgttaagttggaagagtatactgtagaaggtacatacttcactttttttttttttttttttttgagatggagtcttgctctgttgcccagtctggagtgcagtggcgcaatctcagctcactgcaaccaccgcctcctgtgttcaagcaattctgctgcctcagcctcccaaatagctgggattacaggtgcccaccaccacatctggctaatttttgtatttttagtagagacagggtttcactatgttggccagactgatcttgaactcctaacctcaggtgatctgcccgccttggcctcccaaagtgctgggattataggcataagccaccaccctggctcatagttcactattgaaacaaacttttttttgtgtacagaagaaaaaaaatcgtacagttaacagtgtcagagatagtgaaaatatgaaacaagaactgcttacaagaaaggagcactcaggggaccaaacctctgccagagccagcggggaagtgacttatgcctctctcttctttccctcctgtccccgcccctcgtctcccgcaatgaagcgggtacttaatctgtgtcctgtggaggtcccctttggcagccagctggaagcccgtgcacccttcttcaaataatggctttcaatgagcagactaggacgtttaggattgcaaaggaaaccgattcctttcaaacctgattatctttgtgatgtggcactgtttgcatatcttccttaaaatgcattaaaggccactgcactccaccctgggtgacaagaggtgactgtgtctcaaaaaaaccaaaaacactcccccctcaccccaaagcattagacgtcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcgtatggaccttggacatctaccttcctgaacttttctctcctgtttttacattattattttggtttgtgggaaatattcttgacattatcttcaacttaatttttgttcttgcttctactattttagtttaatttccaagtattttgatattgaactttcaagagaacagacatccctgccagccttgacgtctaatgctttggggtgaggggggagtgtttttggtttttttgagacacagtcacctcttgtcgcccagggtggagtgcagtggccttcaatgcgttttaacgaagatatgcacacagtgccacatcataaagataaccaggtttgaaaggaatcggtttcctttgtaatcctaaacgtcctagtctgctcattgaaagccattatttgaagaagggtgcacgggcttccagctggctgccaagtgggacctccacaggacacagattaagtacccgcttcattgcggcagacgaggggcggggacaggagggaaagaagggacaggcataagtcacttcccccgccggctccgacagcgggtaggtccgctgaggggcgttgggtgaggcggaagagcagacggggatccggaaggcgttgtcggtgacatcacggagagggcgatttctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggtgaggaatatgaggctgcggcggggcggaggggtgtgagcttatacttatatttatctggcagaagaaatgttatgatcacgaaggtggtttttccagggcaaggcttagcaattttactctggatgtgctgacccctgtgatttccccaaatgagggaatctcgactacataatttgtggcagtggggaactgtttgtgctttcccctggattgctgtcgttttaaaagtggattttgtttgctgtggaagcatatacaacgcgttagtataaactaataaacaggtctttgttcccatctgtcacttactttcaaagtaaagattttgtcaggtagtggttggttctcacgcttgtaatctcagtagtctgtgagatgcattgataactttatgttaataccgctcgagctctggagtttgatgtcagtgtggtcaaatatggtggacccgtctctactaatctcttaacttttttttttgttctatagaaataaaactaagcttttcttttccctatgggagcccactgtaaacatttattaacagcaaacagttcactggagtgcatggcttactgcaacctctgcctcctgccttcaagctattctcctgcctcagccagagaatactcgatctcctaggtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaagtgtcttttttttttttcccagtgtggcccaaggaagccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtgacaaaaccctgctggaatcctgcaacttctaaccttaatgttagatcaagaagcaaaacacccaccagtccaagggtcagggaagatgaagatcatgcctgagctgtaacaacgcccttcccagcatacaaaagcgtgtaacagccactcgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttttttcttcctcttcctcatcctcttctttctcttcttcctcctttttcctccttgtaaagccatacttaaggttcagataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaattattaatgaatatgatagcgaggatgatggaagacgagaattctcaagaaaagtattggttaacatataaccaaatgtattcatctcaaaataatgaagaaatactcctaactattacaagtcctcatttctgcaactgtcactggccctagctggtatttgtaactatctttacatcttgctctcacagccatttcctttgggcctgggccggtggacgtgagcgtgggaaagaccagaacccgcggtgccccccaccgcactatcctcgggtctccagaggtgggatccactgggcaggggcctttgctggattctaaaccggctctggggatacaagaacagctgcctttgagaaacagttcaggtctctatattccagacttcttagtaggactaaacccttaattttcacccgggaattcatggttctcctaaaaccctgcggtggaatgccttccttcaccgagcatttattgggcacctactaggtgctagggtggctctgggcgaagggctgcagcctgtgcaaactccaggtccctttcctgtggatcccacctctgaggacccgagggggacgcagtgaggacaccacgggttctggtccttcccacgcgcgcgtctgctggcccaggcctggcagaaatgactgtgagcgcaaggtgtgagcggggctaagaatgggaaagagagtgactttcgcctgagaagctgcagttgtcgcctgtagaggggccggcgacttttgagacggtgaagagcaggcggaggaagcagtgaagagcagacggtgaggagcaggtggacctttggccgttggagtcccccagctgactctgccagagtagaacgtccaaagtgcccaaagactcgactcttggcttcattgtctcccgtattatgggtttctggagtgcgcgggattggacaggcatcaaatacatgagattatctgcagccagaggttaaaaagccatttctggtatcagcaaatgagtttaagacacaagccattggagtctctgtggcgcaatcggttagcgcgtttgactgttaactgaaaggttggtggtgcaagcccatccagggatggcaccttttgcttaggcaagattcacactttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacaccagagccactgcacctatttcatcacctcctgaagctgggtttttacaattgcacattcctggaaatccaaaactcccaataattgaaaacaagaaaaccccagtcttcacttgtggtgaagcctcaatttctgggttgaaatcttggttcattcatgacgtgacttttaaaaccttactggattttctgtacctcaatttcttcgtctataaaaaagagcagccaggcgcggtggctcacgcctgtaatcccagcactttgagaggcccaggcaggtggatcacctgaggtcaggagttcgagaccagcctggccagggtggtgaaactccgtctttaataaaaatataaaaattagtcaggcatggtggcgggcgcctgtactcccagctacttgggaagctgaggctggcaggcacctgtaatcccagctactcgggaagctgaggcaggagaatcacttgaacccgggaggcagaggttgcagtgagccgagatcatgccattgcactccagcctgggcaaaagagcgagactccttctcaaaaaataaaaataaataaaaaagaaaaaagaaagaaagaaatttttcctggcacatttctatatgttccattctggatgacttgctcttcaggcttatctcacagctgttatcataatatctctctttactgcaccatcttgggatttccatgacctctctcttgttagatcccctgcttcatggatctcaagggggtgcattcctcactcacttcttccttttgatgatgcatatccttcaagacctcctataaagtggttaccttagaaataaactttttgagacactgcatgtctgaaaatgtcttttatacccataaagttaattgatattttactagatagagatacaaaaagataggtggaaataatttctctctgagatttttgaaggcactgctttttttttttttgtgacagtctcgcctcgctctgtcacccaggctggagtgtggtggtgggatcttggctcactgcaatctccacctcccaggttcaagcgattctcctgcctcagcctccccagtagctgggactacaggtgcctgccaccatgcccggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcaggcctggttgttaaaattcaactgctgacctcaccaattgtgctgtctgtaaattccagacattgtataaaaaagcattatgaaattcccttttctgtcctgtttcattctgattaccagtacatgcagcccccagtcacgtacccctcgcttgctcagttgatcatgaccccccccccatgcagcccctttagagttgtgggcccttaaaagggacaagaattacttgtttggggagctcggtttctaggatgtgagtctaccgatgctcccagctgaaaaaagctcttaccttccacaatccggtgtctgagggattttgtctatgactcctgctacagtttcaaactcctgacctcaagtgatccgcctcccttggctttgcaaagtgctgggattacaggcctgagccacaacaagagctcccggcccttgttgtttactgctttccatagtcatttctgagaaagagaaaggtaagccttttctgctctgagctagagctggtctgacaaacacctaggccatggtgttgtatggttaaaactaaaaatttcacaacaccaatatcagacaaagttaccccctcactaaactgaaagaaatactatttcacaatcatatttgagcataaaaagaacactgttcaaaccataatatgatcaaacatcccagctactaatagtgacggttaattattttattttttatttttttgtgatggagtcttgctctgtcaccaggctggagtgcagtggcacaatctcagctcactgcaacctctgcctcctgggttcaagtgattctcctgcctcaaccttccgagtagctgagactacaggcacctgccaccacacccagctaatttttgtacttttagtagagactgggtttcaccatattggccaggctggtctggaactcctgaccttgtgatccgcccccgccccgctcagcttcccaaagtgttgggattataggcatgagccactgcaccaggccatttttttttttttttttttttgagacagtctctgttgcccaggctggagtgcagggccgtcatctcagctcactgcaacctccacctcctgcgttcaagtgattctcctccctcagcctctcaagtagctgggattacaggcatgcccaaccatgcttggctaacttttgtgttgactgttgattctttaccaattatgtgtttagtcttgcaaccatttctctcactttctagataaaaatatcgagattcccaaaggaagaattgtcccacaatttccccatagtgtttgctgtctcctctgttgcaatgagccaatatactcaggtttgactataggtttgttcctgatggttacacactggagcacatcagcaccatagagaagatggatgccgttctgattctttgttatttgccttaaacttttctcccatctcccctcccaaaagcctatagaatcttctacctcttcctattagtttgaaacttcatgatctatttccatccaccatgctgggtactcagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaatagcaataattggctgggcgcggtggctcacacctgtaatcccagcactttgggaggccaaggcgggcaggtcatgaggtcaggagatcgagacgatcctggctaacacggtgaaaccccgtctctactaaaaatacaaaaattagccaggcgtggtgccgggcgcctgtagtcccagctactagggaggctgaggcaggagaatggcatgaacccgggaggctgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctgattcatttggggctggatggtctaggatggcctcacacatctggggtataggtggattggttggaaaaagtgggatgcatggatctttttcttcatgtgatctctctagcaggctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatggccaattcaagattcaaagagaggagaaatagactctcttgatgagagaagctgcaaaatataaccactttttttttcaatctatcacagtataccatactggactatcagtagcttcctcatttttctttctttctttctttctttttttctttctgagatggagtctcgctctgtcgcccaggctggagtgcaatggcgacatctcggctcactgcaagctctgcctcccgggtttagccattgtcctgcctcagcctccctagtagctgggactacaggcacccgccaccacagccggctaattttttgtatttttagtagagacggggtttcaccatgttagccaggatggtctccatctcctgacctcatgatttgcctgcctcggcctcccaaagtgctgggattacaggcgtgagccaccgtgcccaatgaaaacctttattttcgtgatggctgcttatttatttatttatttatttatttatttatttatttatttttctttccctgctctccctctttttaaatttttattatttatttatttattttttctgcagagatttatccaattcagaggtcttgtccccataatttggaactttcctttggatttgatcaagtcagatagaactggtcaaacccaatggggaaaagaaggaaacaacaataaaaacacaaacagaaaacaaaaaacagttcagaaaattagtgatcgcacaatttatatgattgcctagcactctaacggtaagaagaaattataatcagttggttgttaatcttttttatttttttattttttatttttttttgagacagagtctcgctctgttgcccaggctggagtgcagtggcgcgatctcggctcacagcaaactccacctcccgggttcacgccattctcttgcctcagcctggttgttaatcataactttaatcatttaggagaatttccaagacaaaacacaggttcagttacttacctaggaatggggcccaggctgaagactgctctgtaccatcttagaagcaggaaaaaactcaaactctccttccctccttccctgttagaagtgaactgaaaccccagaaaggaattgcctgctctccatcatcatggaagcaggaaaagttgccgtcattgttggaagcaagtaaaactccagaaaatgagttgtacagcaaaataaagcttagatctcaatcaaattttgggaaatcagggattctctggagggggtggatctctgaggcctcagcaaattgtcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaggtatagcagccaggtgcaaattgtgggggcctggaaataattttggtataacagagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccagtcgctgtttagccctgatttgcatatgagactttgtgctggtcatctggtaacttttcactcggcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactatgaggtgggtgatgattagagcctggattaatcaagggcctgtggcttctaacaccatcagttgcctgtactcagccaccttcagcagtgctatctggctctagagagccatagcattccaggaaaggagagaaggctgcacaaagccctgatgtttgtgtccccccatctagacagacataatagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcagcaatgaagagtttcttcctcattgaatcactaacgcgttttggatctctctgacttcctagtttgctgacctctgacctctagatccagactttaaaggcccatgttattagattagtcaacctttataatctccccattttaaggttaattgtatctgcaaaatccctttgccattcaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgcattatctgagttcctttctcaggaaaccaagcgttgggccctccagatagtatcaaagaactgaaatttaccagagtaccacatctggacaatgaaatatcagaccccttatcccatcaaaattgcctaagtgaccacctgcttcctgttgaccaattcctctttcttacctctccctaattcctgttttcctgcatgtagttccatttcttccctgctatctaaaccctgaattttcattggtcaggaagatggatttgagactgatctcccatctcctaagttgtagtacctgatgaaagccttctttcctagcaatgctagttggctcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagattacaattataaatacacatgcatctaatagagcctcaaaacacaggaagcaaaaactgacagaattgaagggagaaatagacaatttaacaatagtagatggagactttaataccacaactttcaataatggatacagcaactacacagaagatcaataaagaaataaaagatttaaacaacataacctaccagacatctatagaatactccactcaacaaaaacagaatacacttcctctcaagtacacacgggatgttctatagaatagaccatatgttagcttttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctgtaattccaatactttgggaggccaaagtgtgagaataacttgggcccaggagtttgagacccacctgggcaacatagtgagaccccatctacacaaacacacacacacaaaaacacacacacacgcacacaatagctgagtgtgatgacatgtgcctacagtcccagctattcaggaggctgaggcaggaggatcacttaagcctcggagtttgaggctgcagtgagctgtgatcatgccattgcactccaggttgagcagcagagctagaccctttctattaaaaaaaagcaaaaaaacaaaaaactaacatgcttccccagtgggggaaaagatgtcagtataacattggtttgcagcaagaagtatattaagatattgatcaaaatccttttattatttattttgtttttattttttgagacagggtctcactttgtcatccagaatggagtgccgtggcatgatcttggttcactacagcaaaacacacctggacccaagcttgcagtgagcaatcatgtctcactgcaagctccacctcctgggttcacaccattatcctgcctcagcctcccaagtagctgagactacaggcacctgccaccacacctggctaattttttgtatttttagtagagacgaggtttcaccgtgttagccaggatggtctcgatctcctgatctcatgatctgcctgcctcagcctcccaaagtgctggaattacaggcatgagccaccgtgcctagccctatgcctggctaattttttaaatttttttgtagaggcagggtttcgtcgtgctgcccaggttggtctcaaactcctgagctcaagtgatccaacaaccctggtctcccaaagtggtgggattacatgtgtgaaccactgcacctggcctctaaatcgatataaatcaattattcacacactgagaggaatattcaggatttttttcttataatataaatgatgtgaaaatctggagaaccaaagaagaatgccaagactatctaaaagtgttaaatttttcattaggaagaaaatgacttcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgttgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttaggtacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacaaactataaaatttacccattataattgtacagttgaataatttttagtaatttacccaagtagtgcaaccattaccataatccatgcatttgtttttaatttattatttgtctgggttctgattctacttcctcaacaagctacagcatggcagtatctgccaccacttgttttggtccaagggcagaaatcagtatcctggaaaccaatcagtacttgcgctctgaactggaaaagtgcaaacagaacttccaagacctcacagagaaattcctgacatccaaagctactgcctactccctgaccaatcacctgcagaaatatagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggcgagtgtagtgaggaatagagactaaaaccttggtttaggcctgaaactgtctttcccctctcagcaatgaatatcagattctacaaacatgtaacatcactgttggttaaaacatctcaggattcgatttaaacttttttaagagcgcccatttgcaaagcactgtgccaacagcatcagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacatgttactaatagtcagggaagggaagctgtaatgacaaggaaacgtgggaacaagggcatgagaggaacagggatattagaagaggattctggttaacatagaaattgagtttgttttccaatttctacaattattttaaaatacatcattgtgtgggggtggctaaaagttgctgtctaacttactgtcatagaaaagtaaagccaaaagcccacttattaaagaagtgaaaagatgagctttggtgtgtggaaaaactagtttaaaaaaaaaacccttcactcattataattgtaggaaaaaaatttctcaagctagagaagaagaaagatattacctaagaccctaatataaaggtattattgtgcagtgattaaagagcatataccctagggccaaatttcctgggttcaaatctaacttatcatcactgtccctcagttttctcatctgtaatggtaatagagtaggaactacctctttggatggtggtgacgatcatatgatgataattcttaaaaacctactgcaacagtaccgtgacaaacactatgtgttggttttccctttaaaacaccacctactagcttttgggcatatatcatttggatctttctcctctatatacagttttacacagctgtatacagataaatgtttaaatctttgaaatattttgggattattgaaactcctgacacaggagggccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtgtggtggggcacacttgtaatctcagctacttgggaggctgaggcaggagaacaacctgggaatcagaggtgcagtgagccgagattgtgccactgccctccagcctgggcaaaaaagtgagattccatctcaaaaaaaaaaaaaaaaaaaaagaaaagaaaagaaaaagatgtggcgtcagatctcaggggatgtgaattctgactgcctcattccagttgaatcatcttgtcaagtgattttatcaacctgtgggcttttctttcctcatctctaaaacagggagtagttgagagactgaggaataaagatatggaaatcccagtgtaaagcctcgtactggggatacttttatccttgagatagaccctgcctcctgctctgcaagcagtgaccacagcaacatggccagccttccatgatgcaggcatgtctgtcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagcagggcagctcaggctggtagaacaaagagcaaatttgtgcaaggagaagggcagaaatgtatgactcaggcacagaactagactaagacacaatgaggctatggtctagttaggtctctagggttttccattaaatagcatattagtaaaatggagacagctgcctgcattggaatactagcaatgtggcttctatttgtgtgtccttggtcaaatttacttcacttttctgcgtgtcattaacctaggctacctcatttataaaatgcaaatactgacagtatctactcagagggttatgaagattaaatgcacaattgcaagtagttagaaccatctctagcacatataaaactctgaacaactattttctgtaattattatatttgttcccatttatagatgtggtgattgtcattaatattttctataagagatattttcaaactttccaaagtgcctttcatgataacaatgtttctcctccaaactttttaaaaaagtattatactaggtggagtattaactggtagggctattgggtagatagatgattgagcagctgttgtgtggaaaatgaattattaattcgctcaggaccagcattgactatccttagagggtttcagacataaggtagattgtagcattcgaaacttcttttaatcctttgttgaaatgaaatcatagaagctcaaatttctaaaactcaccaaagcagagatatttgattgaaggtgggataggtctggagcccctatttctccccagtatgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgtgtacatactaccgggtgctgtaagttgggtaataggtagcactatctttagactcacagagctcacactctacattggaacccatgtgtattagtctactctgacactgctataaacatatatctgagattggtgatttataaagaaaagaggtttaatcggctcatggttctgtgggctgtacaggcttctgcttctgggcaggcctcagaaaacttacaatcattgcagaagtcaaaggggaaggaggcatggtcttcacatggccagagcaggagagagagagagagcaaagagggaggtgctacactttcaaacgaccagacctcatgagaactcactcactatcatgagaacagcaagggggaaatccaccaccatggtccagtcactatccagcaggtccctggttggattacaatccaacatgagatttgagtggggacacagagccaaaccatatcaccatgagaaatatttaaacaataattagaaaaaaaataaatccccacagagtaatgaaattactactcagaactttactttttttctttttttgagatggagtcttaccctgttgcccaggctagagtgcagtggtgtgatctcagctcactgcaacctccacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcgtgagccactgtgcccggccagaactttagttttaactgccttcttactgattatagtctatcttcatgtcattcagaagaacactgcccctcttgaccttttcactgatttttctttttaactttcaattaatactagggataccggcccaacagttttgaacttggcttttttttttttttttttttttctgccagttactgcatatgaaaagatacttgggctaaagtggggaaccaaaggggcatctttttaaaggaaatttagtaaaataacagacaaacccaaggctgcctcttcattccttctgccacaggcaagtcacacaacttttacaagaattcatcttgggccaggtgcagtggctcatgcctgtaatcccagcagtttgggacaccgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggaggcagaggtggaggttgcagtgaaccaagatcacatcactgcactccagcttgggcaacagagtgagaccctgtctcaaaaaaaaaagaaaaaaagaattcaacttgggagttccttacagggattctaagagatctctcctctgaaacttctataacctgttattcactacattccctcatacattttactcttctttcccaccttaggatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgtcccaaagtggggagaaaaaatgcaaacttatctccattgtagattttattttagttttgactatggtccttaatctgcattctattgttttctctttagagcactcaggtaatcacttttcatattctttcaagaattctaagttttgttttttattttgagacagaatcttgctctcttacccaagctggagtgcagtgacacggtcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggcttgtcttgaactactgagctgaagtaatccacctgctttggactcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccgctgtcttctggcttacactgttccaacaagaagtctgccataattcttatttctgtttctctgtacataatatgtcttttttctctggatgcttttgagattttctatttatcactggtttgaagcagtttgattaagataagaccttgtatagttttctcttttacatattgttctactttatttagtttcttgcatctgcatgtttatagttctcatcaaatttgaataataatgacatatatagtcttacctatggcatatacaatatattatatttcgcatatatacggcaaatatatataatgtatattctattctttctctctatcttctcctttaaagactccagttatatttgtattagctgctttgaaattttaccacagctgactaatggtctgttcatttttgttgtatcttttctttctctccgtttctttctatttccatgtcttggaattgattaatctttcttcagcagcatctaatctgctgttaatcctatccagtgtattttcatctcagactttatttttcatctaaatttaatttatgtcttttttttaaggtcttctatgtaactcttcatcatttcatattttcctctagcttctttattttattttattctattttttgagacagagtctcgctctgttgcccaggctgaagtgcagtggtgagattttggctcactgcaaccttcacctcctgagttcaagtgattcctgtgcctcagcctcctgagtagctggaattacaggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcttttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctttccaagctggctttttaattttttttaggcaggataagagcagctattagtcaactgctattttctttcccactatggaggcaaaatgacctttaagaaaatagaccttattttttagagtagtttcagattcacagcaaaattgagcaggaagtacagaaagttcccatataacccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcatgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccaatgctaatctaatgccatcgttgatctgacaggaggctgagctcaggcggtaatgctttctcgctggctgctcacctcctgctgtgcggtcccattcctaacaggccatggaccagtgctgggggtttgggactcctgttctaaccaatgctccctctattaaaagggattttcacactagctgatggaaacaccaagtgttgcaagctctgtgtgagctacagagattattccttttgggaagttctttgccctgctttgcataatttcctcaaatacatgtactaataagtacttagctgaagattgaacacagatatccaaggcattctctctgtgcagcaacctattctctagtctgtcctgtgatgtctagccaccctgacttcttcaaacttactaccaggctctgcctgggtcctccttccctgctctgcagttgacaaactcaggcagcaaactggagcactcatagggctcatctcttctattttctctctctcagggatcaatgtactgtactgcactatatccaatgttgaagctagagtttaaaatactttttccagtttcttagttgtttaaggtggaggacaaatctagtccctattactccaacttggccagaagcagaagtctccattccatctttgtggtcagaaagaacagtatgacagaaggcagcttgttagaatagaaagatccatggactaagaatcagaattacctaggctctagtctcagcactgtatttactaactttgtgcaagtgattgatccctcctgaatttctgtttcctcatttgtaaagtgagtcaaatcataattccacggctgctgtacagatcagttgaagtagtatcttaatgttcatgagtgtatttctctttcagggttatttatttatttatttattttcaggtcccaatagactgtccaaatcttttggggttagttcaggctctgtatatagtagaagctggtgttagaaaagttgatttataccggaatatttttcatagaatcacccccaattctcaccaacaaactgagaagaaaaaaaaaagaattacccccaagaacatctgaggaagcacaacagggacagacttgaaggtacctgggcagtcctctggttttggagtagaggtaggacagggctatttgtcctctcagagactggagcaggttctgtgtgtgagtagctatgggacaaacagtcatggtctggcaaacagcctgtggcaggaaggaaggttacaactggagaagtccaaagggcagccaggcaagtattctttgagctggggaacaaaagacattttaaactttttgctctgcttcaggcagctgatgtcatggtgatgattcaccacatcaggaacaccctgtccagtgggctcaggcaagcctgccaggccacttctctaaagacaccacctgaggcctcctgcaataaatctcacagagtattctgaacacacatgtaaagtgttatgtccctgatcatataggccccatgtgtgcaatgtgtgaaatgggacttgcctaatttctgactagctctttctaattttggtttgcagaaaatcacaacggtaagaaaaatgaagacaggcaaaagccactggctcctaggtaactctatatgatgaaggggctgataatggactgaccaaatctagagaggattccagaagcaaggactcaagaggttaaaggtcccagatatagaaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaatagtatgggtctctgtgtgtcctgtgtgccctgagtgtattttagagtagctgttgagtctgctgccttatctgtgtgttatgaggtcaatgcactgatcacttgctgttttcacttctatactaactctaggcacactctactcccggtcaaaagtggattgtatatgtcctctttgatgtgatggtccctttggttttggtgcctcttccatgagcttcagatcagaactagctatgtggttccaggctgccttggtttcatcccttgtcttgcctacttcacctggctcaggagggacatcaaggaggaagaaatggataaagtcctggagggacttcaaacagtatttgacccattccagccgccatgactcccaccagcttcgcagcagcaatgccttcctctttgatgcacaggaagacccctctgctctggatatagccagtgagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaagtctcaagtacaggtccctggtgggtcaggtaatttgctctgttcctgtcctcacctcagtccctctggccccaactggcatctgcaagccagtatactcaaagctggccagaatgaagagagtgaagagattatggcagactctctgccactactgccacacatgtacaaatccgcttaacagatctccttctttaaaatgggacatcttatctttcctgaaatatatatattttttgagacagggtctcttgttctgtcacccaggctagagtgcagtggcatgatctcggctcaccacaacctacaacccagggtcaaatgaccctcccgcctcagcctcctgagtggctgagaccacagatgcatgccactactcccggattttttttgcctttttggtagagacagggtcttgccttgttgcccaggctggcctcaaactcctgagctcaagcaattcacccacccctgcctcccaaggtgctgggattacagatgtgagccaccacacccagccttcctgaaatattcttgataattatagttcctgaacagttttcccaagctgttctagccatcccaagaatgttggcaggcttctccatatgtttggaggtgtaactataatggttcctgggtttcaagctccagtctccatctcccctcaggtgcttgctttcccataagtttccatctgactactagaatatcaggggatttccataaagacaagactttgatcttggcaaccctttggtaaatagccagggttctcaatctttgtgcagcaccaaggtatttttaagatctctgttagtttagtctcagtgttgtaattcaatctaaataaacaacgaggctatctgctggagaaaaggatgaatctaacagcaatgccaccagcatgccctcttcccagaaaaactccacgctagccattggagcttctttaggtatataagagccctttaggttggtaacctcactggtgtgtgtatagattaaaaccttgacctatatctcctctcccttacttgaatgtttgactttactttgggggcaaaagtttggattgttaggggactatatgctttatatactcttctatgcaatagaaagagattatattaattcactcattgagctttcacagtaatataaaccatattaggcttgtcattctgtcagtgatgggtgtaagtttgtggcttttattactcataccatcctctgacaaaggcatcctatttctctttccaatttcacaataaggtgcagaagaaggtctttaccatctgttaaagatgttcagggccgggcatggtggctcacacctataatcccagccctttgtgaggcctaggtgggtggatcacttgaggtcatgagtttgagaccagcctggccaacatgctgaaaccccgtctctactaaaaatgcaaaaattagccaagcatagtggtgcatgcctgtagtctcagccacttgggaggctgaggcatgagaatcctttgaacctgggagatggagtttgcagtgagccaagatggtgcctctgcactccagcttgagtgacagaatgagactgtcaaaaaacaacaacaacaacaaaagatgctcaggagagatgttttgtagagaggaagatattccctagtacccataaatcatctcaaggaggtggtcatatctttcctagtgctagaaaagccctattcagaaaccttcagtgtttttccacctcctgtcaacctgccttatacttcctgtatctccatgtgggaggcatccctgtggagtttgcttagcacttggccatgctttgtttgaaaccttaaaagctcttaaaggaagttgccttatgttccctgatgagaagatgaagttggcaaaagaatggtgaaaggcagggatcttgatgagaggcccctgactatccctttagtgatcagcatcttcatttcccgtctcattccatgtcctggtggaatggctgcagaagatgagatccagagacagcggtagcacctgaaggaaacccttttcatcaacaactgcctgtgagaaaagctggaatgtcatctcagcagctttgatgaagaaaatggtgggagaggcccaagtcagtgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgcctccaacttagaggtatctacctctaaaatcattcttgtgattcctaggctgtcttctgtcttctatctgctgctgtacactgcctgctgtctctctgcttcttatgtgattggcattcagtagaacccaggtttctgagcacctcatgtagcagaatgagagtctcctctgctgccatactcatcagcttcccttatgtctcggttactcttcattctaccaccccaaggtggttctctccaacccccctcctcttagattgttctcacacagaggccatcatttcataacattgtgctgggccggaagaaccataaccaggtcccttcccataccaaagcagtaactattttggaaaagcctccttcatattgcagccattggacatgataatacatgtgatgtgctggaatttgttaagaatcatgtgaaaattaagcttctgccccatcgcactaaagttccagccctgagtccccatggttttctccctaggctaagatagagaggaagaacatgaaatatgcagaaagcattctcttaagcaaacgtgtataatttgcctaaattgtaattatttcctggaacagcatgcacctctaaactctacaggcacatcatagattccatcgtccagctgtataatgaaaacagagttctcagagaacaccggagactcccccgacttgcctgtatcaagtttctagaggtaagcggtgaaaatccacaatatgaagtcactctcagacgggtcccttctcttgtcacactccactgtagaaacaaaagaggacggggaagccagagctgctcaaaaccttataacccacaattgtcatagttattctcaacttacacagggctgctttctagacgcaccccctccaggcccccagactgccaggctccaggaataagtagctctgagaaatatagtttttcggtggaagccacactccactattgcaaattggagaagagaaggacaaacttaaaaggtgaaaagatttaagagaacaacatggtgaaaccccatctctactaaaaatacaaaaattagctaggcgtggtgacatgcacctgtagtcccagctactcaggaggctgaggcaggagaatcatttcaacctgggaggcggaggttgcagtgacccaagattgctccactgcactctagcctgggtgacagagcaagactccctctcaagaaaaaaagaagaaagaaagaaagaagaaagaaaacaattgttttagttgaatacattttgtcaagattaaatcaactttcccctagggtactgatagaataagcaatcataatttagattctaacttactggtctttgagaaattgtgaaaacaaaaaaggtgccataagccaaaaaaggagcaaaagtcctaattttcaagctgatgaaaataaagaatgaaaaatattgaaatcgtcatagttcatcttggtccttggcaaaatacaaatctattgattgaaaatataatatcctagctaccttattgtgcctagctcttaccactgaggagaaaaaccaaacgcaaacaaaagtatgttcaaattggcaaaaatgtttacaaacctgcaaaatctcttcagcctatccctcaaactccagacttggtatttactaagctctgctgtgtacaatacccaccttaatatccattcttgcacaagttctgttaggtataagccaagatcacatgggattttttttttttttttttttaccctctcatgcctatgtctgcttttgcttccaaagacccttctgagtaaggactgtcctcagactactggagtcatttagtcacaagcttgcctgaggctcagagctggcaatacctgggagtttatgtcaatcccacagcacccagcaaccttgcctgcaaattatttacccatgattgacaggtgcaggtgtatgaaagtccagctccttgacttgaggggtgcctttgtggtgaattagctttgggaaaagggaatccagaggccaactttgtaaaactccagatagataaatggaaagaaatctttgccttggaagtccagttgagaaagatagtgatttacttcagactgtggaaagagagactaaaatctttactttctcatgggaaagaagcctatggtgaaagagaaacaaagagaatggtgggaaatagggtgggtctactcagtagctttaaaccattctgtcatattataaagcctggtgaggttttaacacaagtgcctggactctacacctagagattctgatttaaatgcttccaggtgggtggaaaccactagtagtcttaaaaagctcccaagtaattttcacatgtggctagagatgaaaaggaccatctatctattagaatgtcaagtcgccaacatagaagtgtcccaaatgtacagctacctcatagaaaaggcttaacaccacccattgatggaattttccttcctctcgccatggttttgtttgcatagcatggaaaaaagagaagagaaaaagaggtagatggatagattgaacctataatttgcctatgtagagcagtttctcaaacttatctgaccacaagatgcagtgagaaatatacaattctttgtgatcagtttttaaaaaatctttcattatgtgtaatccaaccttcctagtatttaaataaagcctgtagtagcaagcagtccactatattgatttcacaacccataacttgttcagaattgcaattagaaattttttttggccaggcttggtggcttgagcctgtaatcccagcactttgggaggatcacctgaggttgggagtttgagatcagcctgaccaacatggaggaaccccatctctactaaaaatacaaaaaaaaaaaaattacctgggtgtggtggtgcctgcctgtaatcacagctacttgggaggctgaggcagaattgcttgaaccctgggggtggaggttgtggtgagccaagattgcaccattgcactccagcctgggcaacaagagcgaaattgtttcaaaaaaaaaaagcaaaaagaaaagaaaaagaaagaaaaaaagaaaaaaatttttttcacttctgctcaacctttttatcaagcaaaatctcaaaagaacatttactgtaaaagaacattgacaacaaacatctttctgtgaatccttatttctgtcccagccaccatgacccaataatctctagagcctgttagtgttctccagattgaagccttccctctaactgctcctaaatctgtgatgtagtggaaaaagtttgaggccttgattctcatcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttaggagggttatttctctgcaaactatcctctctttcttatgacagctatttctgaatgtgcacatttgaggctaagcaaatcccttcctgggaggcgtgaaagacctttatttctctgcagaggagtattatggaaagtcagttgatgctgaggaggtggtagagacctagctaactcatctgcagcggctttgagcaaggcttttagaatcataaggtggctggggtcctgtgtcctacaccacaggccagctagttcatttcaggagactttcttttctatctattattactatcttcttctagactgtagttcactaccagagattatccacttagctgcactcagtttgcacctggcctgtatcaccacttagctctcactccagcctcagttaggtatcagcaagacctcaccaaagattattgtttcattgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacattctcttgcctatcatttttttttgtacaaatcacaattataaaactttcttgctccagctaaaagcaggaaactcagtcacaaatgtgttcactacatgtataccacagaatgatagcaaccagtctgattgcatcacttgattccaaaattaaatgttagcactcagtagtgaaactacatgtatctccaactctggaagccacaggcaagatactcctgtttcctgcagggaaacagatctataagcagggcagcagtctcacacatgtacactcctgtgaaatccaaggaaataatgatagtgacacagggcaggcaagccccaaaactggtttgtagcgtgggaaatttctcccagactgtagtctccttggctttgccaagaaaagaattcaaggataagccgctggtgagagaaagcaacttttattgaactggtgctacttcttgcagagcagggctaacctataggcagtgtgcccagagttggtgcctgtgggctactagctagttgtatttagagccacttttaattgcatgccaattaagaggtaggttattcagaactttctgggaaaggggcagggagtttccagaaccatataaagtaacttccaggccattgccaaggtgtgttgccatgacatttgtaaactggccatggtcccagtggtagtgtctttatgctcataagcagtgagggcaactagaggtcactttcatcatcatctgctggtttcagcaggcttctccactgcaccctgttttgaccagatcctgctctgttcaatggggttgggaatggaaaataagtccttctggtctcctacctcatttccccatcagagattatatactcctccttaatcttaaggggcttgcagaagggcggaggttcatcttctgtaactgcttcctgctgatgttatgggcatagaccctgcctagcactggagaggtaaaatccctggatacctgttctaaaaggctcaaaggtaggatgtctttatcttctgggtcagaagaggggatgggttgaaagccttgtgccagcatcatctttacatggaattattgtaatctggaagacacaaactttacaaggaggttaaacaagcaaagagcaaagattagtaataaaaagatatctattaaaggtcctaggaagggtaaaaaccaagtgtctgctggtagagattcctttactgaattccatcagcagggcaaagcagtaagagggaaaacattataattaggaataagagaaaaactttcatgctcatccacagcatcatgttattattgttatctgtgcatttgcaaaacaatagctttaagtcttccgggcgtttgcaaatataggtcacagcatcgtcctctgacatctgtgaggactcataacaatctttgagggccgggggcggtggctcacgcctgtaatcctaatactttgggagactgaggagggcggatcacgaggtcaggagatcgagaccatcctggctaacatggtgatatcccgtctctactgaaaatacaaaaaaaattagccaggagtggtggcgggcgcctgtagtcccagctactcgggagcctgaggcaggagaatggcgtgaacccgggaggcagagcttgcagtgagttgagatcgcgccactgcactccagcctggggacacagtgagactccatctgaaaaaaaaaaaaaggatctttgagcctgggcatagtggctcatgcctgtaatcccagcactttgggaggctgaggcaggcatttcacaaggtcaggagttcaagaccagcctggccaacatggtgaaacctcgtcgctactaaaaatacaaaaaaaaaaaaaaaaaaaattagtcaagcatggtggcacgtgcctgtaatcccagctactcaggaggctgaggcaggagaattgcttgaacccagaaggtggaggttgcagtgagccgagatcgagccattgcactccagcctgggtgacagagcaagatttcatctaaaaaaaaaaaaaacaaaattaactttgaagtttaacagcagtgggggtgcttaataatgcctgataggggccctttccattttggttgtaattgattcttgggggattcttctttctaagtttttagtaagactaagtatcctggttgaatgggcgagtcaatccttttccttgtgggaggaggttacgtttcacttccatatgattgaagggccttttgaacctggcctaagttgataacctatgtatctcttcaacaaacagaacgtctaaagttaaaaagggccttccgagctgctcaggcgacccagcctcccatcgctgctgctctagtgttcggttggcctgggccacactcaactgtagggagcccaggccaagaggcagcctgggccttctgcattgcgaggcgccgggcctcccgcagcgctccgctgacgggctgcgggcgggcaggcgggaggcctagtgtgggtcgcggtcgtggcccccgccgccggccctggccgccgcatcatgaacatagatgtggagttccacatccggcacaactatacctggaacaagttgccggccaatgtgagacagtcattaagtggagatggctcatcatggaggtcttcatccttgtcttcacaagtaggctgaagaggaggaaatacaggatgtattggtcttgctgttcagggtggtagaggaggaagaaaatcccagtcgtctttgaaattcacagagaatatgaaaagcaggttgtcctgtacagtatctgcaatcagttacgatacagaaataacttaaacatgtcaagaaagatgaatgcagatactatgaggaagtgctaaagtacagccaagatcatctcatgctgtacccttaccatctatcggatattatggtgaagggcttgagcataacaccattttcatattatactgggattatggagaatattatgaacagtgagaaaagttatgattcattgcccaattttactgctgctgactgtctaaggcttctcggcataggaagaaaccagtatattgatcttatgaatcagtgtagatcatcaaaaaaattcttcagaaggaaaacagcccatgatcttctaccaataaagccagtggaaattgccatagaggcgtagtgggtggtgcaggctggatatatcacataagatgacatcaagatacgcactttgcctgagaaatgtgcctgagaaatcagcttcatcggcaactgatactgatacaaatagtcaagaagatccagctgactcagccagtgtaagcagcctgagtctgtctacaggacacacgaaacgcatcgcattcctgtttgactccagtcttactgccttcttaatgatgggatatctttcaccagttcagagcactggtgaaggagaagcacagaggtattttgatcatgcatttactctgagaaacacaatactgtttctgcatcataacaaagatctagttgtgcaaactgcacagccagaccaacccaattatggttttcctctggatctcttatactgtgaaagccttcttggtctggaccctggaactttcagcagagttttaaacaaaaactacacgctgcttgtttccatggctcccctcaccaatgaaatccggcccatcagcagctgcacccttcagcatattggaccagctatcccagaaatcagctctgtctggtttaaacggtacatttatcatatcactggacaaggaccaccatcccttttattgtccaaaggtacaagacctcaaaaactgccagatatatttcagagttatgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagagttcactcgtgtcaatatgggtgttcataaagcattgcagatactaaggaacagtggacttacaacatctctgcggatatgtcaccatgttgaatgtttccatccaacttgcaaatagaaaactcagtgatgcttctgatgagagaggaaaacctgatttggcttctggctcagatgtaaatgggagtacagagtcatttgaaatggtcattgaggaagcaactacagattcagcaacaaagcaaacctctggtgccacaacagaagcagattgggttcctctcgagctgtgctttggaattccactgttcagttccgaattaaactggaaagtttgtaggaaaattgcgctaaataacttatcaaaaaaaaatcattcatatttaaacatcttctcaaacgtcagcccattttctggcacaaacaaggaagcagttctcagtgatactatctgtccaaaatcaagtgcactcaaaccatcattttcttgtttgagtagcttgggctaccactcaaccaataaaacatcataatgttcttaattttctaaactgacaaggctatataataaaaggtacaaaatgtatataaccactcatcataggtaagtggcggattttctttcagtaaaggatttaaatactattatacttcaacagtcaagctagacttactttctaggtcttatattaatgttaattgagaactttcataattacttcctatataaagatgagaattatctgactttgaatttctatcatattagaatatactttaagtcataattgtgagtttgaaacctacatcaataatactatataagttctaaattaattgtaaaatattgtcaaaaaaattaaaatatttacatatcattatccccaccatatgcattggaaagagattattctttatgacatattctggtatatttcccgtgaatctctatctcttgtgaagtttcttcttatgcaatgcctggtcaccagggatctgtgaggttcatgatagaaatactaatagcagttactgaagtctgagctgacttgtgtgttgcagatgctgtgtgtcagagtgaagtattcttatacagtaaagtacatttacttacttaagtccaactgttccctagttttccaaggtcaaggaaaaaaatgagttataaaatggaaatggaaaaactctctctggttggctttgtggttattgcaccaatatctatttcttagaaattttcctgctagccaagtacagtggctcacacctgtaatccagagctttgggaagccaaggcaggaggatcccttaatcctaggacttccagacaagcctgggcaacacaggaagacatcatgtctacataaattaaaacatagccagtgtagcggcacacacctgtagtcccagctacttgggaggttgaggtgggatgatcatttgagcccaggaggtggaggctacaatgaggcaagattgtacttgatacggtttggctgtgtccctatccaaatctcatcttgaatgtccatgtgctgtgggagggaccctgtggaaggtaattgaatcatgggggcagttctttccggtgctgctttcgtgacagtgagtaactctcaagagatctgatagttattatatgggggagttttcctgcacaagcctctttgcctactgccacctacgtaagacgtgacttgctcctccttgccttccgccatgactgtgagtcttccctagccaggagttcaattaaacctctgtcttttgtaaattgccgagtctggggtggtctttatcagcagtgtgaaaacagactactacagtaaattggtaccagtagagttggggctgctgaaaagatacccaaaaatgtggaagcgactttgaaactgggtaacaggcagaggctggaacggtttggagggctcagaagaagacagaaaaatgtgggaaagtttgggacttcctagagactggttgaatggctttgaccaaaaacctgatagcaatatggacaataaagttgaggctaaggtggtcttagatggagatgagaaacttgtcggggactggagcgaaggtgactcttgttacgttttagcaaagagactggcagcattttgcccctgccctaaagatttgtggaactttaaacttcagagagatgatttagggtatctggtggaagaaatttctaagcagcaaagcattcgagatgtgacttgggtactgttaaaggcattcagttttataagggaagcagagcataaaagttcagaaaatttgctgcctgacaatgtgatagaaaagaaaaacccattttctgaggagaaattcaagctggctgcagaaatttgcataagtaactagaagccgcatgttaatccccaagacaatggggaaaatgtctccagggcatgtcaaaggtcttcacagcagcccctcccatcacaggcgcagaagcctaggagaaaatggtttcatggtccaggcccagggtctccatgctgtgtgcagcctagggactccatgccctgcgtcccagccactccagccctgagtaaaaggacccaaggtatagcttgggctgttgcttgagagggtggaagctccaagccttgacagcttccatctagtgttgagcctgcaggggcacagaagtcaagaactgaggtttggaaacctctgtctagattttagaggatgtatggaaatgcctggatgcccaggcaaaagtatgctgtagggggcagggccctcatggagaacctctgctagggcagtgcggaagggaaatgtggggtcagagcccccacacagagtccttactggggcaccacctagtggagttgtgagaagtgggccactgtcctccagaccccagaatggtagatccactgacagcttgcaccatgtgcctggaaaagctgcagacactaaacagcagcctgtgaaagcagccaggaggggggctacaccctgcaaagtcacaggggtggagctgcccaagaccatgggaacccacctcttgcatcagtgtaacctggatgtgagacatggagtcaaaggagatcattttggagctttcagatttaactgtcctgctggattttggacttacagggggcctatagcccctttgttttggccaatgtctcccatttggaatgactgtatttattcaacgcctgtacctgcaatgcatctaggaagtaactaacttgcttttgattttaaaggctcacaggtggaagggactttccatgtcttgaatgagactttggactggacttttgagttaatgctgaaatgagttacgactttgggggactgttgggaagacatgattggttttgaaatgtgaggacatgagatttgggaggggcccagggcagaatggtttggctgtgtccctacccaaatctcatcttgaatttccatgtgttgggggagggacccagtgggaagtaattgaatcatgcgggcaggtctttcccatgctgttcttgtgacagtaagtctcaagaggggagttttgctgcacaagctctctttgcctgctgccatccatgtaagacgtgacttgctcctccctgccttctgccatggttatgaggcttccccagccacatggaactgtaagtccaattaaacctatttcttttgtaaattgcccagtcatgggtatgtcgttatcagcagcataaaaacagactaagacagtactccagcttgggctacagaaagagaccctatctctataaaaataaaataaaaaatgttcctgctattcaatactacatcgtatcttcttcaggatagttcatttgggaatcgctaagtttacccctgactctagggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtccttgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatgtcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaggagcttacagtgaagtagtctcaagcaattgctttcttttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctctgcctcccccctccccccaccccacaacagtccccagagtgtgatgttccccttcctgtgtccatgtgatctcattgttcaattcccacctatgagtgagaatatgtggtgtttggttttttgttcctgcgatagtttactgagaatgatgatttccaatttcatccacgtccctacaaaggacatgaactcatcattttttatggctgcatagtattccacggggtatatgtgccacattttcttaatccagtctatcattgttggacatttgggttggttccaagtctttgcttattgtgaatagtgccgcaataaacatacgtgtgcatgtgtctttacagcagcatgatttatagtcctttgggtatatacttctcaaaagaagacatttatgcagccaaaaaacacatgaaaaaatgctcatcatcactggccatcagagaaatgcaaatcaaaaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcggggatctagaactagaaataccatttgagccagccatcccattactgggtatatacccaaaggactataaagcaactgctttctaagtgggatggctgaagcaagagaccttaaatcacttgaccgtcttcacaaaacagaactgaagcagaaccagaagtcccctgatagcctttcagggacaccacctacaaatacaccgtaatccctcatactccacacgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgccaagactagacttaggcgttttatcctttttatgacattatgtatgttgaagagaatatatgaatacattttatatatatgaatatatataaaaccttcattatcacattattctcaatccagcattttctcagcccctgattttcatgttagttcagcattcttacatctttacagattttcatctaagactacatttctactgttttatataatcagcccccctaagatcaacatgtccacattttttggcaaagacaaagcctactgatttcaggatcattattttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttctactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactatataatattaaaattctgcatgtggcataaaacatattttaatggagaaggtaatgtgtagggagtttatttctgtttgctattagaacttgtgtttattcttggttaaaaaaactgcactgattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttcttttaaatttaattaatcctcaatgtccttgtaaaatagccaaagggaaaatgtatttacattactctaaatattgatgcaatctacaaaaagggttaaacaacttcctcaaagtaaataaaacgttcacaatccagctaggataaaaggatttaaatcatttcctaggtagagggctttcaattagagcccctgctgcattaaccatgggaactcatctcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggataaaaatgtaccctatgttcactattcagtattcataagtatactacttatgaattggaaatctgacacaacatttacatgacctaattttgaaaatttaaaatagtgtaaggcccctaggcttaattttacaggggaaagattaaagggacacaagcaaacatatattctctctctgtgctgtgggacactggtaattttttgacttaaaatatttgatacttaagatgccaaacttctacatttctgcagtaacaaggcagttatcatattgaataccatttctttctctccagtaagtagagttaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactacacattaagcacagaagaaaatgaaacaaacaaaaaggttttaaaccaaccaaacatatgtcttattttggatgttctatatgttcttacattctctcaggtcttttgtgtcattatgaacacaattctaacaagcttgattattttatttccattcacatattacaggcaacaagctgaaaaagtagaatggggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctactctacagcttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatcctttttattttaaataaacaggatctaaaaaaaataatgctgggaagtcctaaccacatcaagaatgcctcagatcagtgacccaaggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatctaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagattttttttaagtgaaagcaagcttattaagaaagtaaaagaataaaaaggtggcttctccataggcagaaaactagcgtagtttttttattagaaattgttattcaataatagtacatgttacaaataaataccattttaaactgaaaaaattgtagactttcaaatcagttagggtggtcaccctaaaaaagggcatttttttcccgttagtctccttgttcatgttgctcacaacaagaaatgggctcatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatattatatgtacctatatatatcaaatatgaagatatgtttatagcaattgcatatacatagagagatagtatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggctcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcccgtgtaatgttccggggtttttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaaagtttaaaatttttcttggccccagtcttatcatttctgagccaaatacaattctatcgaaatcacctgaaactgaaatcaccattctaggctggttttcccataaagatggactgctccaaaaaggaatcaagaaagaatttggctcacagtgaattattcactttgtcttagttaagcaaaaataaaatctgactgttaactacagaaatcatttcaaattctgtggtgataataaagtaatgaccgcttttcagctggagggactaactttttttttttttttgctgcatatatagctgtggtacattttaatgtgaaatgatgactgcatcagcttatatccatggagcagattttagcattcagcttgggtctcccagtcaatatctacgagtctcttcttaaggagatcaatgacacagatacatacagactaacaaatgtgataccaataatcaagaattcactcagttaagattttgcacactgatttccacacaagaaacctagaatttactagattcttgtgcctgtgaggctccactcgtttccctgaatcacaaaagctacagagtatttagatagaaatatacctactcttaacatgaaccattttaaatatatgtattactgtgtccacaggagtacactttaaagcagggacttcactcttcaatctctccaatcacgtgttacctaaagtggcatgtggttccctaaagcttaataactgacattgccttaaaaaaggggtttgcttcccgactaatgtggaaaaagtctgaaaaatgattttaaatctttcactaaatttctcatttggtcacatggaggaaagtgatttcaccaaatagatactctcattaattttttaatgtaatttatcaaagaaatgaaatatttagataaattccagatttcccccaccatgagcttctccgaaagtatactccatcacagactgctcactaagaagctctactgtagtcaaagtgaccgaatttaaggggacataatgactacttctgctacacagaaacattatccatctctaacacttccctatgagacggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggcatgaaatgccaaatgccagttaaccaaagctttctttgtcataaagcaacttctataaaaattgctgaaaataaattcttcatggctcaatgtgaatcagtaatttccatttctattacactgttgtttacccaaaaactatttttaatgactaagactcagagtttgccagagtgttttccacaaaacaactgttttgagatactccagatctgtaatcaagtaagtctgaaaaaccccaaatacctcactcacctcttggatatgcataaagcacactaatatataacgttctaaaaagccaatcattaaaactgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgactttattcttttaagcagctctgtgcttcacaattttttttttcctggtttgttttccacttttgtctgtactttattccttcacagatgtgaaaggctaacaaatgtaaactagttatattaatcagcctctgcctcagttctacacttcaaatacagtatatactctatcaacaattcttggataataacaacctgtacttgtttttcaaacaataaaacaggccgggcaccgtggctggctcacgcccataatcccaacactttgggaggccgaggcgggcggattacctgaggccaatatggtgaattctcctctcgactcaaaatacaaaataattagctggccgtggtggtgtgtgcctgtaatcccagttacttgagagactgagaggagagaatcgcttgaacccggggggcagaggttgcagtgagccaagattgcaccactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaagatttcaatagatgtctccctctaaaattaatattggatgatttgtcatcttccatttaataccaaaagggtatcagccacaaactgaaatatcactcatatgcaaataaataacattcaagacttttatcgttgtggttattaatcttgtaatggatggacataaatctatttacattctcatcctatcctcaaatttcactattctctcctctcattcttactttgttctactcatattctcactctatcctcctatgcataaaatattatgtattctaatgaacagagataccattcgtcgacaaggaaaaaacacaatgaactgctctttataataaaaaccatgatcttgacacagatgttatcaatcaataaactttacacagctttacattaaattaatacaaactgctgatgagtgggtggggggtggtcactaagcaaacagaagcatgtaggtgttaggaagcacgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatggataagaaactcaaaatcaagaattttaagacactgggttaaggtgattgagttaagtcaaagccaacagggcatgggctaaatattgacatgggatgggatgaagaggccaacaatgtttcaaagtagaggttgccggagcttcaggaaccagaagaggaagacttgaggtgaaatctgaaactgcaatccccatgcctggctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatactaaaataaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcagacactacctttgccaaccagcagattttcagtactgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcactcaagcctctgttttccctgctataaaatgtaaaatagctgacaaaatacctatttgtattttttggaaacatgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctcactaactcattcagctcccttcatactccctccccacagccacctcagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaatgctgaatggcttcaaaataactgcatatgccaagatttctggagtgggcacgtttgatcttctttcataatgaaaactgacaaacctttttagggggatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccgggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgtcacactggattcatatgaaattccactgcaagtgacatcaccagattggggaccctgaagtgtttgagtatcttctccacatctggtcatttaggctaagaaattccttcttgtctaccaggtcttttagcattcattgtgtaagtcattcaacacctacttactgagaaggaatactgggctagacagtgtgctaggggctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacataggcaggcaactcacatcctgccaaatattaaatttctaattttattataatttctaataaaacattagatttattattatacagagtcatactcctcgattgggaaactctcaactcaataaacattctttagtctcatgtcttttctaaaggaaagaaattaatgttatattcttgggtgaaaaaaaatgtgaggtctcaaaagagtataatacaatttggggatgcatatatattttacatgtatatagacacataaaaatctaaaagaataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttccaaactgtgtacaattgaagcctctgctttatagctcttagcacacctctcaaataagaaggcagtactgggaaggctctgaacctgtggcagaaccaccgatagctgtggagctattccaaggagtctgggaatcaggggaattatcaagatcattgttagaataaattaatcttactgtatatatagcagaagttttcaagcatatgtaaatgctactaataaccaaataattacaccttgtttttctttaaactgtaactctcaagtatgtctctacataattttttgatggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattcttggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcaccattaggtacaaatcataaagggattatctacggttactacactgtaacaactttttacatattgtattatagaacaagcttttgagaagacaaagcaacacatcagcagtttaaccaattgtctttctcttttaacaggctggtctacactagattacatataaaaggcccaggtattacttgtgttcgatcttagccaaatggctgagaaacatccaggtacatttaaatcagtgacaaaagaaaacattatcccttagtaaaattacataaaataggaaacatctcttactttaagagcaaccatggtacttgttcctatggtgaaaactgatgttatctcgattagttaattattcatcccaacacctggtcttgctcccttttccacctctagctatgttaacactagagttcagtaattagctgataaagaatcttaactgcagtatctaacagatcttagtgattaagcatatgacttaccctttgtacagataagtaaactgaggccaaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaggatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcaatgtgccaattctgggtcttaggcatattgtatatactggaatgatattcactttaattaaatttgttttgagaagtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcaaaattggatttgggttcgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaatgtacagagaattggcaggctgcatgtttatgtgaaccttcagaaaacatggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgtgggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaatctgaaacagaaagtcctgtcaaaagctacccctggagtggatttgttttaaccccgatcaggacttgggccctccatttggtggagtcaggggaggcctggccgggcgggaggcgagggctagagggcggcgaggtctctccgcgcagcgtccgaggggatgcggcgcgcccccgactgggtgcagcggcaggccgcccccggcagcaagtgccgggtgccatggcaacggcgggaatttcccggtcggggaggccggaagcagccccagccgggctcgcggcagcgaaagcaaaatccgatctctctcccgggggagcaaaatggacgaacggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagggcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccactcgggttctgccttcaaagctagtagctgccccagacttgggggtggggggaggggaaggggcgaggctggcgccccctcccgcttttggctcccgcgttcgttgcagcagctgtcgccaaatgaaccccggaatgcggacgtgcaaaccctccaccccacccccagccacacacgtcgcggtcggagaactgagaagggggcgctgggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggagaaggaggaggaggaggaggaggtggaggaggagggggaggtcggctttccatttccagatgtgaccgcccagctgctgctcgccgctgctggattccagtttcctccccttctggcgatggattggtgatgacaccgagtctcactttctccttcccccgcccggaccaaccgccgtggggggccgagggtgccggggacggccggagagcgatcaccggctgggcggcgggagccgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctcccccccatcacttttatgaattcgactccactttctaaaggaattatgagtcttgtggcaaacacaaaccggagtggccgggagggggaaaaggggggaaaagaaaatctttaaaaattaaaaaaataataaaacgaacaaatctttacttgttgccacatcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttgttgatcttttctccgctgagaaggctcctgccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaacgcctttatctttcaggaaagaaattacaaaatagtttcattgtccagtcatattcactatgagttataagaggaaacattctatctagaattagaaataccatttgacccagccatcccattactgggtatgtacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatagatgaaattggaaatcatcattctcagtaaactatcgcaagaacaaaaaaccaaacaccgcatattctcacttataggtgggaattgaacaatgagaacacatggacacaggaaggggaacatcacactctggggactgttgtgggttggggggaggggggagggatatcactgggagatatacctattgctagatgacgagttagtgggtgcagcgcaccagcatggcacatgtatgcatatgtaactaacctgcacattgtgcacatgtaccctaaaacttaaagtataataataaatttaaaaaaaagaacaaaacatcacattgtaccacataaaaaaaaaaaagttggattttgcaaggaagatagacatctgactaaagtttggcctagcaaggaatctttgttagtactacttcttgtttaaggaaagaagagacactcatctttccttcaaacaatataagtctcttttcttgtttgatcaccttttattcattaaggaccagttgaatcatctgttgggacttggtagcagaggatatttcctggatagtgtgagctatcgggcctttaatgtgggaagtttagtttctatacaaataaaattaaaaaagattaatagttggaacgaactataaagacagtttctgagcccagagggcagctgatcaataagatttctagatgctgggcttgtagtatcttcagctggagtgagaagaggcattggattagtttgcagtttgaatgccataaagatgggccacacacaagctgttgtggtaatttttctgaagcttatgtcaagtcatccagtttcagtttgaaggacttcaagaaatgaaaagtttataattttagtgattccaagccagaatagcaggaaaaaaatgaaatattaatttggagtgttgtagctaaatattgtagtaaactagaaaaattgaggatctattgcagattgcaggcagataataaaacctcagaaaaaaaaaaaaacagctagaatctaatattgggtgcactgcagttttctcctgaaacataacttttctctctatattcactctcatttctgtcaaagataatcaaagtcagattgatttgtttgctaaataagtttaatctcattaaacttgtactggttatgtacacaagtgcagttaagagtagtgattgaccctttaggctcttttaaaggttgcgttagtcagataagaaatctcagattaaactttttgtttttgtttttttagacagagtctccctctgtctctcaggctggagtgcagtggtgcgatcttggctcactgcaacctccgcctcctgggttcaagcgattcttctgctcagcctcccgagtagctgggattataggtgcgtgccactatgcctggctcattttttgtatttttagtagagacagggctttcaccatattggtcaggctggtcttgaactcctgacctcgtcatccacctgacttggcctcccaaagtgctgggattacaggggtgagccactgtctccagtcagattaaacttttaaaagccacttgaggctgggatacaagcccaaaacttgtcattagtctgcacctgttacatttatagatttagataaatttctctcttcttgaggtccctaaaatatcccaaggtttccagacccaccaagcagtgacattctttacttacctgtaagtctgggaaccctagagccagtttttccaagatggtactttattggttccataaagccaactttagtcccctaaagccttctggtcatatctgaaaacatgatgtttcagtcaaagccttggtgatataacctgtgtttccagtttgtcctgttacaaagacaacagattcttattaaacttatgcaaataaatacattgtcataaaaataagaatatacacaaatagtttccaaattctggagggataagttagggggaaaaagtaaatgtttccattttgcacaaaagtattctttactgaattggtgtaagctagagatagcttaaaagaaagttttctgaaatctggaaaacaaaacatttaaagaactagcaatgtttccaacaaaaagtcattttaaaaattattctcatcagttcattcagtaccatgtaattaaatcttgttttgcttgatcttgggttagtagttacatgaacccatcagttttattagagttctggaaattcttaccagtccaattgtatgacgttaaacttgttcagaaacctgtattccagaatactcataagagtattttccataaatctccttgaagaagaagccattttggactgtagctaatttcaaatgcttttagagagcaattaaattaaaacaataactgtctacagatgacaagtacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaaaaaatattctttgtggctttttgagggtccaatatggagaatcctaagttaatttgaggtcaaaaagacttaacttagaatgtgattttgggaagattgtcaaaaatgtcaaaaagtttaaaacatttaaaacaaatatgaccatagttatctatttaataaaagctccattaaaagattttaaaggcaaattcagattacatagttgtgaacaagaacttagctcctttaatattgagaagactcacttttcttaagtaaccaaaaacctaataaaacaacatgaaactcaagaaattatcttgatgaaacagagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagacatcttttcttatttacttttgcaacagacatacaccagacaattaagcagtttacttttactacatattctactcttaggttgaatttatggttttatggccttaaacatctaacagtaacaacacaaacttgtctaatcagcaaagccaggtaaaacaagtgtatgctgacaattctgaaaatgtttctatttttattttaccaatattttttaaactagtttttatttactaaggaatatcccagattatgtgaacttaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttctcatttaaaaaattttaaccaggccaggtgcagtggctcatgcctgtaatcccagcactttgggaggctgaggtgggtggatcacctgaggtcaggagttcgagaccagcctggccaacatggcataaccccgtctctactaaaaatacaaaaattagctgggcgtggggcatggtggtgcccggctgaggcacaagaagcacttgaacccaggaggtggaggttgcagtgagccgagattgccccgctgcactccagcctgagcaatgaagtgagactctgtctcaaaaaaaaaaaaaaaaaaaagtttttaaccatgaggcagtaaaacagagtaatacaaaaatacaaactcactggtttatctccgctttatattgttatccaaattgtgtttctggtgaaaaagggataagttgagttgacctacataacaaaggctaaagctttttaccaatatttgtggaggaggttttttaagattttttttttttttttttttttttactttatcagtttccaaacagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaacaacaatttgtagcccagggaatcagggaataacccctcactcagaaaaagagagccagaaagaagagaattctagtctagggactcagagaatagaccactcagaacaagaagcccacacgaagaccttcctgcccagaggattgctttcaaaagaagcctgggactctaccccagcttcagagagaatattcatcccttcagattcaaaatctgtccttagccatcaacgggcttttgtctggagcaatggctcaggaatctgattcaccaatggatccctaatcagtcagaaatgacaacaaagacttcaaaggcatgcatttagggttctgagtgagaggcccaggatccagtgatgaatctgtcctagttgagtttcaacaccataattgttaaagaaaaaattattcagtgatacttcaaatgcacagtaaagaagactttattcaggaccatcaccatagatataggaaccactgcaacacagtcttggagctggggagagagatgggcttaactctgaatacggcatggggaagtgggaatttatagcccaggagcaatgcaggggtcagtgaatggaaaatcactaagaggaaacatcaggagtaagggagagtctggctaaaccgacctaaaagaattcttgctgaagactggccagggtgatcagacatcacctgcagaatggtgaagaatgaagaacctgatcagatattgagaatgaggggttctttggtaaacttggcagtgttctttgctaatgctggattttgcgaggaagtgcacagtttagcctagctgaagatttagaagcctgactaaagttggccaagcaaagaatctttgttatcaacatattccatcaaacctcacatccctgccttaaatgatcaaaccatccgcactcttgtatgctactgttctccatgaaaagttacttcttctttgccttaaccaaaatccagccattctagaaagacaccagaaggctttctgcagcatctaaaattccccacattctaggcccaaatccttttcctttccctgttgcttttagatccacattgtgtaaccctcatctagaaacctcagtttcttggagtcatttttttttggggggacggagtttccgctcttgttgcccaggctggagtgcagtggcacgatctcagttcactgcaacctccatctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcgtgagccactgagccaggccattctgtctttttatataatgtaacttgtacttttatgtagtaaattatcacaaaggtgtcagacactctgaggaagagtattttactgtatcattcccattacccaatcaggaagtcttaacaggcagattttaacaaaaatataagacacaactgtgccctagcttttctcacatacttcctacctcacacttcacacatttctttttctcagcacccactcttaagtaataatttatttcccctgaatattatttaccttctgtgggctactttacatatcatctgaaagcatgatcaaaacagttatatttgtgaataattttattttggtttatttcttagcagaaggaggagttaatagtaacatttgtaggctgggcacggtggctcacgcctgtaatcccaacactttgggaggccgaggcttgcggatcatgaggtcaggagattgagaccatcctggctaacacggtgaaactctgtctctactaaaatacaaaaaaattagccgggcgtggtggcgggcacctgtagtcccagctactcgggaggctgaggcaagagaatggcgtgaacccaggaggtggagcttgcagtgagccgagatcgcgccactgggctccagcctgggagacagagcgagactccatctcaaaaaaaaaaaaaaaaaaaaaaaaaagaacacttgtaatctcccagagattgccaaggaaaactttctcctggctgaatttatgtagagttcatcatctaagcataaaatattttataaaggaatgggccaatcaaataactgctatgcggttgacaccataaaccaagttagcttagtaccactctaaatagttgctgggaatataatgattttcaaagacatgatctctagaaataaataactgaaagagaagcacggtgtcatgcatttatgcatacacataagcagggactagagatcaagaatagaaataaaagaggtttttacacttggggtgctaagatcgcaatgatttatttggggagaaaacggaagcccttctttagtaaatgcaaagcaccatgtgtttaatgaagatacatgacctaagctttgaagatcgtttaactaattcaataaacttgccaagtatccattactacatctcaacaatcaaatttacagtgacatctttgagttaaatctctccatagatgtctggaaacagcttaattctgttaactgctgcccattgaattatgctttatttggtcatagaatttcatgtcatctgttagtctccctcacaacttgggagatgttattcctgtattgtctgttctcgttgatgaagagaagtctgtgataaagtaattgtccttcctttgcaggtaatctgccttccatctctggttgatttgaaaatattgtattagtctttagtatcttgcattttactgtggtatgtctacatatggatttatacttactgagtttgctcagagcttggagtatttcctcagtcttaaaggccctagttgtgaaaatgttactacagaaaaactttctttttttaacttaaaatcctttttattgggaaataaatgtaagattatagatgtttgaaaataaaagaattgttagaacaaaaaatactcatatgcctgttaccctaatttgtctattattattttattaaatttaggttaccatttgttctctctctctctctctctcaatatatatcccaattttcagtctttagatctaaatctttcagcaacctggactatcatggccccagtgtaatgcttggctttgtacctcatgagggaagaaatgtttttttttaatcttaagttctagggtacgtgtgcatcacatgcaggtttgttacataggtatacatgtgccatgttggtttgctgtacccatcaacttgtcatttacattaggtatttctcctaatgctatctgtcccccagccccccaccccctgacaggccccagtgtgtgatgttccccaccctgtgtccatgcattctcattgttcaactcccatctgtgagtgagaacatgcggtgtttggttttctgtccttgtgatagtttgctgagaatgatggtttccagcttcatccatgtccttgcaaaggacatgaacttatccttttttatggcttcatagtattccatggcacatatgtgccacatttttttaatccagtctatcactgatggacatttgggttggttccaagtctttgctattgtgaatagcaccacaattaacatacgtgtgcctgtatacatctttatagtagcatgatgtataatccttcgggtatacacccagtaatgggatcgctgggtcaaatggtatttctagttctagatccttgaggaatcgccacactgctttccacaatggttgaactaatttacgctcccaccagcagtgtaaaagcattcctatttctccacatcctctccagtatctgttgtttcctgactttttaatgatcatcattctaactggcatgcgatggtatctcattgtggttttgatatgcatttctctgatgaccagagatgatgagcattttttatgtgtctgttgactgcataaatgtcttcttttgagaagtgtctgttcatattctttgcccactttttgatggggttgtttttttcttgtaaatttgttgaagttctttgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctggtcatgaagtctttgcccgtgcctatgtcttgaatggtattgcctaggttttcttctagggttttttatggtgttaggtctttcatttaagtctttaatccatcttgagttaatttttgtgtatggtgtaagaaagggatccagtttcagctttctacatatggctagccagttttcccagcaccgtttattaaataggggatcctttgagggaagaaaattatttttaatattttaatccagctatgtatgtaaaaagaagtctttttcatattttatctattagttctgtatgattggagtatgagtcaaaacatctcaatataaataaaaagttacatttcagtaattttttttctaaaattacaaaacactagtggtcaaaaacactactatttccaattctctttactttgttaacattactttttgtacttatgagagaagagtttgcaatccaaaaagagcaggaaggaagagagattagagattttttctcccgcttgctctatacatatgagatatttatatatctatatatcaacagttgacctttgaataacactggtttaaactgtgtgagtccacttataggtggattttttcagccaaatacagattgaaaatatagtatttgtgggacgtgaaacccacatatgtggagggccaacttttcatatgcgagctctgcaaggttgactgtgggacctgagtatgtgcagacttcggtatatgcagggctcctgaatgcaataccccactaatactgagggatgactgtatatgtctctatctatctactctatcacatatatatatatatatatatacacacacacacaaatatgtgtatatatatatgtatgtgtgtgtatatatatatatatatatatatacttcctatattactttgctagggttgttataacaattactgcagactgggtgagttaaacaacagaaatttattttctcacggttctggaggctagaagtgtgaggtcaaggcatcagatgtgttaattttattctgaaatttctctccttggcttttagatagtcattttctcatcttgtcttctcatggacttttttctgtgcacatgtatgtctgtacctaaatttcctcttcaaataaggacaccagtgatattggattaggacccagacatgtgacctcattttacattagttacctcttaaaagtctctatctccaaatatagccaccttctgatatactgggatggcagggggcagggtacagcatattaatttggggaaaggacacaattcagcctataacatatgcaatatattcttctctgatctatattatataacttttatatataatacatatataatttaatatacattttaaccccttgattaattttctcactgcagagaaaacaagaattaaagaaaagcttcaggtgataccgtttttgaatgagtaagaattgagcctacccttaacacaagaatgaagtagaaataaactgacttagggaacagcataaaaaagttctcttatgagtcaagatttcagtgtgatgtcatcatattttccagggattaaatgttagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctctctgtaatattttgtttccaaatgaggctcacattgaattttctcttgttagaaatataactggcaagaccaatcaaaaccattcattccattcagttgcctgtgaacaagcttgatttgctttgttattaatatagcttcttgtgggttaagtagaaagctcttttgtaaatatccctcagtttaagtacatatggtttacatttccaggtaaactataaattctctgagaaaggcccagcacggtggttcaagcctataatcccagctctttgggagtctgagatgggtggatcactggaggtcaggagtttgagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccagcctgggtgacaagctggactctgtctcaaaaaaaaaaaaaaaaaaaatctgtgaaaagatctgtgatttccattctcctttatagtaattgttaagcactcacaattagatggttataacaactaacaaagaaaaacaattattttaataaatatttttcatcattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcttagatttgaattctgtcttcactgcttcttttatgatttgcccaaattacttaagctctttaaaccacagtctcctcatccttaaggtagggataataaatagaacttatctcataaaattactgtgaggattataagtgattatgaagttgattaaatttccccagtgcttcatacaaagaaaggactcaaaggatatgctagttcatagtaggggcatagaagaagatatcccttctctcctgggatatagggtatacataactgtccactataaaattgaagataggctagagaaaagctaaaaatgaagaatctaataactctttagccaagagaaaatgaaacatgagggaaagggagaagttccaaatgaggtccacatttgtcgtgggccactgaatggtggtgccattcaggcagaggaaacccagaaggaggagtcattctgtagttagagggcacttaatgagataatattagagataactgaggttgagttgttggtacatatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacaaaaaggacacattttcaagaaagacattgtcaatagtttaaatgtcacaaaatagtagagtataatgcaattaaaaaaacaaaatctattgcttttgttaattaaataactagtaacctcggctgcagcagtttcagtagagtgaggagagttgacaccaaactgcaccagtggagtgaaaataagtgggaagaaagagtgaggaagtggaggacagtcttttttttttttttaataaaatattttcccaaactgtcttttctggaacttccaacatgtctgcttaagagcttgtctaagttgaattcattcaaacttcttgaacctaattagtttctttttgctgtttttttttttttttttttttttttttttttgagatggagccttgctctatcacccaggctggagttcaatggtgcattttcggctcactgcaacctcctcctcctgggttcaagcagttctcctgcctcagcccaattagttttaaagacgctgcatatattggcagggaaaacctagaacacaaagtcaaacttccaattatctcccttcagtgctcaaatcaagagttcatttgttgcaaggaatggggatttggactccagggagaagaatagagttttagaaggagagttctcctaaaactaaatggaaggagggttctttgagataccaaggatttgcaggactttatttacaatgaaatgttagtttcagacagcccaggaggaataggtctattaaaggaaagcaagagtagttggcgtaaggaaacaatttgcattggagcctgagagtgagtatagtaatgaccacatgagagacccatttgactcaagtacttcaaagcattgccagtgttagtctttgctccacaatcaagtggggaaaaagtgaaatgtctttgaagagcatttcctgtaggtggcctttgaggaggtcctgaaaattccaaacctgcaagtattaatggcaaagaataaaaattctttatgtaaaatacttttaaaaatctttctaaatagcaagacattatatattaccattgttaaaagatgaacgaattgagaaatatcattagaattatatgcagcagataaaatggtcactttttcttttgagacggagtctcgctctgtcgccaggctggagcacagtggcgtgatcttggctcattacaacctccagctccctggttcaagtgattcttctgcctcagcctcccgagtagctgggattacaggcacgtgccaccaccccagccaatttttgtatttttagcagagacggggtttcaccatgttgggcaggatggtcttgatctcctgaccttgtgatccacccgccttggccttccaaagtgttgggattacaggcgtgagccactgcgcccagccaaaaggtcactttttaaacttaaaaattattaagaaaacagtgaaaacttaatgtttaaaagagtagaagatagggaaaattattatacagaaaaagataaacaacagagaaagataaataaattgccagtgaatatgtaaaaagttgctcagcaccagtggtagttcaaatccaaatagcactgagttagcatttgttaactaataaattggcaaaaattatattttgataaaacccagtgttgctgacatcccaagaaaaagggctatgctcacacagccttggagcatgtgcacattgatgatttttttggcataaaaattagtggtttctattaaaatcagcagtgtaactcacaatcgctaagacatggaatcaacctaggtgcccatcaactgtggattggataaagaaaatatggtacatatatgtcatggaacactttgcagccataaaaaagaataaaatcatgtcctttacagcaacatggatgcaactcgatgccattatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaacaactactatgtctagtacctgagtgatcggatcaatcatgccgcaaacctcagcattacacaacatacccatgtaacaaacctgcacatgtacccactgtatctaaaatcaaaagttgaaattataaaaaataaaaaaataaaatcaacaatgtatatttctctcacacagccatcacgatgatgtatttggaataatatatgcataaggatgttcattgcagtgttgtctgcaagggcaaagtgaaaacaatctgaataaccaacaatatgacacagagtaagtaattattggtacgtctgtacaatgcctcatgcaatcaccactgacagcgtgggaaagagagacatctattatgaaaagaccactaagacatatgattacatgataagtgcaaggttcatgaataaatagcatgtatactagtatagcatacttctttctaagaaagaaaccataacacatacaagaatggacaagaagttattaacaatagctaactttggtgataagactgtaggttgtaaaaagccagactttcatttctcattttaaacccaatgaattatttaaatctaaccctactgcattcattatctttataataaaataaatatgtataacaatgaaacatagtttttaagtatttgggacataaattaaacattaatagattacacctcttaaacttggtactttagtatcccatttctctgtgagaactctgaaagcttcatcttccacagtttaggtaattctttggtgtcttattttgttattttcttgcctgagattagcaatgtcagatctccaaactgctaactcttctctttggcagatcaaatgcttcttcttaaaaaaattaattttttaaaatgtatttcataggatttttgttctctctctccctctttttgtgcatatgtgtgtgtgtctgattagtctttattatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatactaattaaaaacataaacctggtgaaacccgaacatagaggctccagttcaaagatgcttccaatagttgacatggcccttcattccttaaaaccagctatttttctttcgaattacattacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaattatggtggccctccagggagctaatgaatctttaattatttagaggttcacatgagaccccttacagatataagcacattagctctttagctaagggaacatttaaaaacagtaacatgaaatgtgtcagacatagaggaaagatgaagaagcaagtagaaactaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaattttaatacatctgtaatatgaaatatttagctataaatactacaagtgcaaatgaatttttttttctacttctgcattcaacttttctcttctccctttacggaaaacacttttgtgtaaaggcctccaaaatatatgtagagacgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctaaccaaataatgaatttctcagcttcacaatgtttaagtgacatgagtcccatgcccaattcttggtcattgtaattggtgcatggaaggaacgtgtgccttctgctaatcaaatcagaatgaagtacaactttttcattccatgattgaagagggaaatgccttctttccaaatgcagcagaggaagcacgaggtactaggattggaagttgtctactcatgacatgatattttaagccatagaataaaactgagacctaatgtcttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgtcctcacatggtggaaggggctaggaagttctctaaggtctcttttataagggcactaatctcattcatgagggctctgtcctcatgacctaatcaccccccgaagacccactgccaaatatcatcacactagggattagatttaaacatacaaattttggggggatacaaacattcaatctatatcacttaaggtagagtgaagaaacagggaggacaagaagcatttattttgtgtcattattaaacttctgcattaaactatcttgagcctatactattgttcaaaatctctttattatacaagccattttgaattttgattgtttgcaaccaaaattaacctaataagttaaaatgtactataatgttacatcataatttgtctgtactagtagtatttgctagagtgtttaggggaatacttgcttgttaactttttagtaaatataacactccatgttcaaatacatttgggaaatgctgagcatttcacacttttagagactcaaaacaggcagcacatttttaaaaaataaaaataaaaccaaatagcattgcatttggagaatggtacaaaaaaagagaatttgataaaccggagttatcagaactcagtggatactatgtgttagacattattataagccattaaacattttacaagcttgatacctgagttaaaaattaataacccaaagacacattggaagagaaaagttgacatatttttattatattaatgacctaaaaatatcatagcaactaacctcattatagtcaacaagtgaatgaatgtaaataatattaaataactattagaaagtctctctgattaagcatggaaataaataggcagtgcttttgaccaataaatggaggacttacaatattttccaatacgaaacaaaaagattctaaatgtaaaggttttaggcccaaaatatgttagtcaattcatgacagcagaaattcagcaggtcatatttttggggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggattgaggcaaaaaccctgaattataccaatattatcttttttttttttttttgagacaggatcttgctctgttacccaggctggagtgcagtggtgcaatcatagttcactgcaaccgcgacctcctaggctcaagggatcctcccacctcagcctcttgagtatctgggactacagaccctcatcaccacaacacccgtctaatttatttattttttgtaaagatgaggtctcactttgttgctcaggctgacaagtattatcttaatgttatagaaaaaaagtaattctggccatatataggtattattctttgcagtggaatagcatttcagaaatttgtgccaaacataaaattagttttctagtagtaaaaagtaattaaactctttaaattattattacccctaatatactggggaatgggtgtgtgttccaaatgaaaaaacttgggatgtctaatgagatgctgttttctgtcgcagaaaatctatgtaaaatgttttttctcacgtgtacactgttgatatttgagacagcacatgttaacacttcaagaagtaaaataaatgtgttgattatatccacagttttcatatttattaactatatatttcatttttaatgtaatgcctattgaaaaacctgtaaatagttgtttcttaaaattgataaatactgcctaagatttttctgtatattttcatatttcaattttcctgtgaggttagaatgaacacttttagctaagacatttgggcctccaaatcctaaacctttcagaatgttagtttattatttggtttttacctaaattattttctgcttattcaagaaccttaggtctatccagttacgtttttatttttttatttttatttttttactttgaaacaaagtctcgctctgttgccaaagctggagtgcattggcatgatctcggctcactgcaacctctgcctcccaggttcaagtgattctcctgcctcaacctcccgagtagctgggattacaggggcataccaccacacccagctaatttttgcatttttagtagagatggggtttcaccatgctggccagcctggtctcaaactcctgacttcaggtgatctgcccacctcaggatcccaaagtgctgggattataggcgtgagccaccatgcctggctgtatccagttacatttttaagaccagccaggcttaatatatatttggtctttagctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagagagccagatcaaagctaggcagccaggaaatgtaccccaaaccatgctgtagaactcatccagggaggaaaccactgtcaccaccagtaagaagtaacaccgaagatgcagacagcaacaattgcagcaattgctcaatcctaggctaactgcaaagccaccagcaccactcccacttgttcgctttgcaacagatattgtagcagctgctacatggcctccaccagaaacaagagaaagcataactgaatctgcttctttttttattaattccgaagtcgaaattcagcactggcaaacagattggcaaaacctaagtcatatgcttgtaccctagctgcaaaggaggctgagaaagcaagcatttggcattttagcttctaaagcaggaggtggtttcttgttttcgtcaaaactgagaggctgaggaattcctcaaacacagaaacaaacatcaaataataaatattcatgctttcacttgctcaatatcaatataaactttcccttttgaaagtaaacatgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacgaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtcaaggctctcctttctgcaagtggccagcaggtcactattggcatctatggccatgtgccctcagctaacacctctgctagtcagggttttgccttgtgagatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagggttcactctttgtgtggtacaggtctaggagttttgcaaaacgcataatgtcatgtacccatcattacattattaccaacgtattttcaatcccctaaaaatcgcctgtttcagaactatttatctccctacccatccccaaactcctggcaaccactgagcttttttgttgttgttgttgttacttagtttttatttcataatcataaacttaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagtgcagatgaaaaactgggaaccatttgtgttgggtccagcatttgccatggacaagatgccagaacctgtatgctttcggatgaggttctcatcatcaaatttctccccatagatggacttgtcaccggtgccattagggtgtgtgaagtcaccaccctgacacataaaccctggaataattctgtgaaagcaggaacccttataacgaaatcctttctctccagtgctcagagcacgaaagttttctgctgtctttggaatcttgtctgcaaactgtttgatggagatgcggcccaagggcttgccgtcgacggtgatgtcaaaaaagatgacggagttgaccatggctgatagtacagggctcacagcgatggcggcgtctgcaaagataaccactgatctttttactgtctttatagtttggccttttctagaatgtcgtatagttgaaatcacagtatgtacccttttcagactggcttctttcacttagcaaaatgtctttgttttttctgtatctttttgtggcttgatagttttttccttttagcactgaataatattccactgtaggaatataccacagtttgcttatgcagtcactcattgaaggacatcttggttgcttccaagttgtggcagtcttcatttctttctttctttctttctttctttctttctttctttctttctttctttctttcttctttttttttttttttttttttgagacagagtcttgctctgtcacccaggctggagtgaagtggcacaatctcagctcattgcaacctctgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgcaacagtgtagccgcattttaaattttaaatttttgactgtttctttaaaggtctcaggcaacctaaaaggctagatagaagtctctcatcctctaacgaaggatggattgtaaaatggaatactgctaagactctccctttgggtactaattctgcaaaaacctagaatctcagagacaagagataagtatttggagtggatcattagatgtaatgacaaaaggagtcacttcaacattcataacaaatatcaaagattgttgtattttttatatgggagacaccagacaagcttatacttagttactagttcagaggatacaccaccacatcctctagcatgagtacaaccttataagccattgtctccagctggcactgtgattgagtctttaataaaatattcaccattctataataataataattttggttagtgataggataaatggtggaccaggtgagtccaatgaatatctactcatttgttatacaacaagttcttttaatagaaggatgtagaacaggatattatggcagtatatataaggcattcaatgtacccgtggagagtggcgatcagagaaaaatgatgtcaggtaaagcaaatgtaattcaaggataaaggtagattccatttacaaaattccttgttgcctttatcatagaggagctccaataaaatcaacaagtctgacaaaaggtgactggtttattcacccaggatatgttattgtgtgcttagccttggactttgttgcttgtgtgttggacacctaatagtcttgacagctaaataggcttttgtaagcgagagtggtaaagtccaacatgttgctaaacctatgtgtattctctactgctaccaccaatgttgctgtttattagccttctgagcaagcaatgtagtgcctggtgaaagagattgtttcataccttcatatctatttgataaccttcctgatgatagtttggtgagcattcgtattaagcacaaatattcttacactctggctcattttctgtggttcatctacatactttttccccaaaactcattgccaccaatccttcagtctttgtctttctgagtccctaattatcttttcttttcttttttttttttttttttttgagacagagtttcgctttgttgcccaggctggagtgcagtggtgcaatcttggttcactgcaacttcttcctactggattcaagagattctcctgcctcagcctcccaaatagctaggattgcaggcacacaccaccacatctggctaatttttgtatttttagtagagacggagtttcaccatgtcagccaggctggtttcgaactcctgacctcagacaatccacctgtcttgtcctccaaaagttctgggattacaggtgtgagccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgctgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttttcatattttttttgcattgataggacttcagtttctacaatggtccaggatcaatcaagagttctttaaagaaaacatttattttgtcaaagaaagaagcattttgttccaaatcctaagaacaatagtagtggtgtgtcagaggctctattgcatctggatataaaaacaaaggggcacaatattcctgaccagttgggaattattatcttgatctcaatcccatcaaaatgtggcagcatgacaagtcatgaagtaaaaggcccaggtgataaaatgaggtctccaaaatccaaagcatcaaagttcttagttagtggtcagggctgcaaagtgccataattttgcactttggaaggtatatcttgagaatattgagtgtatgagacaagttaaaaggtcatgcagccagacgcggtggctcacgcctgtaatcccagcacttagggaagctgaggtgggcggatcatgaggtcaggagttcaagaccagcctggccaatatggtgaaaccccatctctactaaaaatacaaaaattagtggggcatcgtggtgccctcctgcagtcccagctacttgggaggctgaggcagcagaattgcttgaaccctgaaggcgaaggttgcagtgagctgagttggcgccactgcatccagccttggcaacaccgcgagactctgtctcttaaaaaaaataaaaaaataaaaataaaaaaatgtaaaagttcatgattaacacctctgttagcttctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaaaaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctcgctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcattttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacgttgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatctcatttcctaacaactttcattgctgagatctttgggatgggatgggggtgcagttctaccatcaagtgggaaagcagtctttaagtgaataatagtaaaatattctcacatttctttgctattattattattattattattattattattattattattgagaccgagttttgctcttgtcacccaggctggagtgcctgcaacctccgcctcccaggttcaagtgattctcctgcctcagcctccagaatagctgggattacaggcgtgtgccaccatgcccagctaacttttgtgttattagtagagatggggttttaccatgttggccaggctggtctcgaactcctgacctcaggtgatccacctgccttggcctcccaaagtgctgggattacaggcatgagccaccatgcttgtcctgctagtattattttatgcattctcccttcagaagttagcttctagatgccataatgttgtgatttgttttataaaccacccaaattgatgtgctgtacagacaaaataaattaaattaactcagttctgtgggtaaaggtttttgctatcccaggactgtggcaagttgggttcttacatgttctagtttcatgccagcacctaaaaactgtttcaacagatggagaggtaggaagacagcatgagtccctgtaaaccaaatacaatctggctgctctaattttagtctcagtgtttttgaaggaactcagaaataaagcaatctacagcctccagagaaagttgcaaaagtttttacagttttcagaattatccagctgattataagtacctcagtctttcacattttttttttttaactagctagtcacatattaaatagagtgaacctacagggaatgttttagctagtactttaaaaaaaatagcaacatgaactgtttataccttgagttgtaaaaattcttattcaagcttagtcttactctgtgagatttgtgagtcagtcatttttatgagacccaataaagattactataaaaggtaccattccacctaaaatatgtcttctaattataacttgcttgaaaggcaaacaaatgaaaacaaaagttgtgtttggactaggagtgccagttatttgtaagactatattgcaaaagtaaattccatgactttaattaccgcctatattcattcattcatccattgattcatcacttaaactaacatttattgagtatctgctgtctttcaggcactgctctaggtgctaggaatacactggtaaacaaaacaaagcccttgttgtcacggagctaacagtctagcgaggctacatcagatcattctgctccctggttaaaacctcttcaatagccaaaaatgaaaataaaaacctttccataccaaggtccagatctatgctgtcaagaataatagccactagccacatgtggctgttgtacacttgcagtggggctggcctgaattgagatgtgctgttaagtgtaaaatgtacaccagatttcaaagagtaagaccaaaaaatggaatataaaatattacattagtagtttatgttggttacatgttgaaataatattttggatacattgggttagacaaaatatatgattaaaattaactttcctgttttggttttcttttgaaaatgttgttcttcgggtgcggtggctcatgcctgtaatcccagcactttgggaggctgaggcgggtggatcacttgaggtcaggagttcgagaccagcctggccaacatggcgaaaccccacctctactaaaaatacgaaaattaactgggcatggtggcatgtgcctgtagtcccagctactcgggaggcagaggtgagagaatcacttgaacccagaagacggaggtttcagtgagccaagatgatgccattgcactccagcctgggcaacagagcaagactccgtctcaaaacaaaacaaaaaaaatgtcgttgcccaggtgcggtggctcacacctgtaatctcacactttgggaggccgaggcaggtggatcacttgaggtcaggagtttgagaccagcctggctaacatggcgaaatcctgtctctactaaaaatacaaaaattagccgggtgggctgggtgcggtggctcacgcctgtaatcctagcacttagggaggccaaggcaggcggactgcctgagctcaggagtttgagagcagcctgggcaacacggtgaaaccctgtctctactaaaatatgaaaaattagctgggcatggtggtgcgtgcctgtagtctcagctactcaggaggctgaggcaggagattcgcttgaacctgggaggcggaggttgcagtaagctgagatcgtgccactgcactctagcctgggcgacagagcaaaactccgtcttaaaaaaaaaaaaaaaaaaagaaagaagaaaataatgtccaaaggccagtgacttcatctagtttttgttgtatttccagcccttgtaacaatgactaccacatactagttcctcaatacaagtatagcttaaataaaggaatgaaatcaaatagcacataagaagagcttgccaatttaaattattaggattgtcatttataatacaaaccccttctaaatacaaaccccatctaaatgagaaaatttcaacttttatcctcctaaaatgaaaataataacacgtctacttctcaaaagattatagtaatagctctcagctgttgtaatttatagtttattgagcactttaacattcatatttgctctttataataacttgataaggtaaacacagaagattattaaatttctatcttaataagacagaatggctgggtggggtggctcatgcctgtaatcccagcactttggcaggctgaggcaggcggatcacctgaggttgggagttcaagagcagcctgaccaacatggagaaatcctgtctctactaaaaaaaaaaaaaaaaaaattagctgggcatggtggtgcgtgcatgtaatcccagctactcaggaggctgaggcaggagaatcacttgaacctgggaggtggaggttgtggtgagcttagatcgcgccattgcactccagccttggcaacaagagcaaaaactccttctcaaaaaaagaaagaaagaaagaaattaaggtaggatgcagtggctcatacctgtaatcccagccttttgggaagctgaggagagaggatcacttgaggccaggagtttgagatcagcctgggcaacatagcaagaccctattgctacaaaaataaaaaacttagccaggcctggtggtgcctgcctgtagtcccagctactcaggaggctgaggtaggagaatcacttgagcccaggagttcaaggctacagtgagctatgatcatgccactgcactccagcctgagcaacagtatgagacccctctaaaaacaaagaaagaaggagtaataacctagaaattaaataagaaaacagaggttcagcagtttagaggctaaaggagttcactcaaggtcacatagagagtaagggtagggtcagacctcaaacatgatttttattattgtaaatccaggtgtttctcccccctaacctacattgccttgttctgaaaattgaagcggatactgtgaatacactttgaaaactgtaaaattatatactaatgtgaagcatcagaaaacccttttaaaaaatagctctaagtaataagtaatttttcaatggctcattgcatgctttataccagtccttgttgcagcccactgaacctttctctatgctttggtgtcaatatccatcttccaaacccagagctatccagaatagtgccacaaattaccattttaaacatgcgatgtccttcagtttacatttgcagattttggtgaaatagcatcttccagtgaagtccactgcgctggagagagaaaggtataaaaagacagtcagatgtactttacaaaaaatttaattgtggcaaaaaattaacaaaatttaccaacttaacaagttttatgtgtgcagagcagatgtgttaaatataatcacattgctgtgtaatgaatctcctgggttcaagtgaccctcctaccagagtttcctgagtaggtggaactataggcgccctataccacattttgtttatctgttcatctgtagaatcaatggacatttggattgcttccacctcttggctattgtgaataatgctgttaatgaacatgggtgtgcaaatatctcttccaagatccagttttgaattcttttggatatgtacccagaactgctggatcagatagtaattctacgcttgatttagcacaaattttgtcaatccaaagagctgaaagctaacatagaagtatagtatatttttaaagagtcagttcatatttgtgagctcaacataaacatctgacaaattttccattaaaaaaatttttatgtgttcattgattcacatacatcttagcacgctaattcattattattttaacccctacaaagaagggtagaaaataggaaaaacatgattctattctagacttgggtctaacctgtaacaattcacctagccttccttatgactgccctattacttaccatagctattgcaaagatgaatgggttaatattttaaatttgtgtatgagctactaaaaagaaaaagcagtggacaatgaatcacagaactttgtagcagtaggttctatgatttattttctagtgttttcccttttttgaaatacatatacgatgtacacacacacaaatgtaaaatattaacttagaatttaaaaaaattaaaaagattttaaaataacacatttatctctgcaataaatgagagcctttggctttgctgttagacgtgattacacttagaccaattcagaaaagatttcaagaaaggaagagtacacagctttacctgggtaaatcaaaaaacttgtaaagtttctatcattatcatgaaattcatttaaaatgaattgtggttattaacctgcttcctctggctctatatccaaagacttagagaataactgtccactcatattttggataattactttccttttaataataaaatttcaataaataactaaattttgaagattcatgtagggcatatatatgttgattatggaaagggaaagtaccatttagagctagaaagaggtttatttgagtcaaataaaatggctattttaccaaataggaagcaaattcttaaggactctacacccaaaagcagttagtggctgaaaacaaacagattttaaaagggttcaattatgggaacaaatgtgtaatgtccaaaatagtctttattggagataaggattaaggctaagtctctatttttcatcccataaaaatctatttacatctctttcagagagagagagttttgaggaaagaaaactgaatttgatgaacaacggatctgatttaggatgccaattgcaaataatgatagaaaacggattttttttttttggtgcaaaatttcatggataaaaatgaaaaacttaaatgacctctcctctccaacagtacagaaaattttgcctgaatttacctaaagtctacgccacggacttgattcagtgaaataggatggttgggcagggcactgaaccagggatcaaacttaagagatgtgtggtcgcatgactgcaattgaactagaagcattacatcaggactgaccaccttggctaaaccacagactttgtccagacagtctgcccacttagatatattccaaggggatcatcaaactggtgggagtggctgaaacaccgaaatgataacctccttgttgactcccacagatccaagccataagtgttcccatttagttaaaagctaccgttgcccgccactagcatgacttacttggtaggagggatgtctgtagagaaaaggtctatttcagtatcagccagcaaaacagccttcattcccctagagctgagcacttgtttacagaatttgcaacacaggatggacacgcacctgtccttgaaactacaaatgttggtggacatggcgtcgcaggaaggatgaggtgtgggattttgaaaaaggaaacaagagtaatgctcctactattttgattcccctaggctaaaattcaaattgcgggacctagagcttttctaagtcctaatattgggaaggaaattagtttttttttctgttttcccggtggcggagtagaagaagtatttattgagtaggaacaggggagcgtggcaaacttggctttccttttaacttttggagaagggagtggagtttgaattggagaggaggcaggtggagtttgaagggaacttctcaacggctttccctttctgctgtctaaaggagtcctctacacttcagctcccgccccttcatagcaattccctcagccttctccgatcgtctaatttaaagcttctcctcttttaagacatcccttccccagcattaagcccctcccccggagcgctccggttccctgctgtcggatctcgggctaagcgtccctacccacgcctcctcttcccaggattcagaaactcccttctctttttctgccaggcgatcccggattctcctccgtcccgccccttttctcccggaccttcctccgctctgcgggtccgcgggcccctctcctggcaacccccggccctcagcgtgctcgcgctgtttctctcgcgtcctcccttccctcagctgtccctcgtgccccccgcagtcccctcaggtttcttcccggagcggctgttcccgggcgcgcggtggtgttggtggggcagagctgaagtcgctttagaggctcagtcggcgctggggtctgtcaccgaacacgttggttttcgctccctcttccgcttttcctgcctctccaacccggtatcagtttgaattgccagcgccgcgcaccgattggaagaactagagttagccccagtccctcattggaaggctccggggcctcccctcacgagagcttagtggcttgaagaccgtaggcaccgccccagtaacggtgctgagatcaattcggctttctggtcggctgagcttggctccgcctccgatctcattggccggcttcgggaggtttcggcaaaccctgctttagccctagtgaaagtggcaaggcacgcccttcccgcttcttattggaagagggtctacagtctccaccggtctctactctttattggttaaaattccccgcaacacccctcctctctaccccggcccaattggccgtgcctcagctcaagagtttgtgtttggtcgtcggttccaccttaatcccgcccatcagttctacttaggggttcaacaacccggggtggagcttaatctgtgaccacgcctcggcagtgctagtcacacctccaagttttgccagctcctccccctcattccgggcctctcgggatcagctcttcctattggctatgggccccatcggtcgatagaaaacgggcggtgattggtaaaggggtgggctctacttcccggcggggtcctgcggagttggcggaggctcctccagggactggggcacagatctgcgtagaaacgggtggcggggaagagaggggaggagagctctgagtgggaagcggagccgggggcctgggacccgtcgcgtcagagccaggtaaaggctccttccctcttccttttcttcctcccggccgccgggctggagccctgactgaacaaacccgggctggggcgggaaggagagggcgcggatgctgctcgcggcatcgccttagcggtgccgcccggaatccctcagaccgcccctcctccaccctctccaaatctcccagtacagcccataatacttctcaggactgcgagtctctccgcccatcactgtacagcctgggactccgtcctggctcacggaccgcagcgcagccggcacccagccgcctctccctttcctccgcacacgggcagccgcggtccaccgtagggcagtcgtcgttggcatcgcgcgtaatcatcggccggcctcctccagtgtctcccagccctggcggacagcccgggtcccagcctaggacccaggaggatgggtgttccgcgcagcttccggggctctccccgagtcccaccccccggcccgccccgatggacttctcttcgcccactcccatccctagaccacatctcggcccccacagttcctgacatccttgcgcttcacgcaacatcgcggcccatgatcatgccccaattcccctcacctctaaggcagccttctccttgccgcctcccgccttccgagcgtgtgcaactccagttgtccccgggctcccttccagcctcaggaccccatctcacacccgcctctcgcttcccgcttcccgctcgcctgaaccccgccgcctctgctccctgtcttgttccctcagcgtggccccttcctccagccgcgggaagtgggagacgctagcgggagcttcctcctcccggcgctcggaggaaaaggaaagaccaagtagaaagggtcgccgctgcggcacgcgagggagctagtcgccgggctccgcgctcccgcttgcgtccctccagccccctgggcctcgtccggggccggatcttctcgggcaccgcctggtgcgaggagtcaggactgcgacctcaccgacctcctcccatccccagcctgggattgggtgggatatctgggatctctgagcttgggtgtcaaaaaaatattgggggtggcatttatagtcactatcgtccctagcttgagggaggcgacggctgccttccgctcgccgccccccggttttcccggctccgaccctatcctctaacccgtttcctgcttcagctgaccacattgttttcctggatgtgtcccgtgccgagcaggctttttcctgcagatttgcccccccaccatcaacattttgctgccaagagaagctagtaaccaaaaacaaaacaactgggaggaggggcgggagaggaagaaaagttgtgccctggtggcttgtccctccccggctttgatcccctttgatgtacagggaggtgccccggccgggggtctggggccacgtcgggggctaggtcgggagggctccctggggctggccgctgcccagcgctggcggggctcaggaggccgccgaggtgccgcattccccgcccggtgccccgcgttcctgcagtccccgcccggagcccgcgcaggcggctgctccaaagtgttttctttcagccttaaaatccggagggagcttccttcctccccacctcgtagcgccaggctctgcgggcggggagacgttaagcggacaggaatgggcccagggcgggctcggaacgacgtcccctaccccacccccgccgcgattaggatctgcgctctggctgatcgccccctcccccttttcctgcatttacaggcaagtgaaccggagcaaacgacttccgatccagtctgcgctgttgcagctcccgtttgggatttgatttgcagcatctttgagcctctacgacaaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaagtggttggattttttccgtggatctatcaattcacaattcgaatttggaagaaagaaggaaaacatgacgtctccagccaaattcaaaaaggataaggagatcatagcagagtacgatactcaggtcaaaggtaagggttttgaaaaatagcacactgcaaatgctctgtggactggtgaggcgtgtatttccaccgtgatttgcaggttgttcatttctttgggtggagcagatgggggcaggctgaccccagaggtggtttcatagatgggtctgaacctccaaaggatgggcaatgccagggggccattgacactggaaaggaatttttgcagtgggctgtaggagtatctttgtggggctgaccatgattttggcagccctttccccccaagccgggcagggtggggggaggggcaggaggctcttagagaaaggcagtttgcctccggttctctgggtcaggtttccttgaaagacaactgaaatctgacaggtgtttggacatttgtttcagagattgaagaggagtccagacagaaaggcaaccttgggaaggtgtaccatttggagagccttgggagaggcggggttttttggatgcactatattaaaacatgagatttgcaatggcattggcaccaaaagtccattgccaccttgggtgtaccttgtacctgcctggtctctggtcggcctgcatacaatcagagatcagagaataaggccacccacgcccggtctccgccctcacctaaatctgaatagagttgggaggatgttagggtagccggttggtgctgattctggaaaatgggaagacataattgtttaacccttctgtgctgtggccctctgctccggaagacatgcttttaaagccccatttccctctcctgaaaaatgtgaagggtaaagcaaaatgtggactaggagaaaccaagtgacctgtcttctcatctagtcgactgacttgactcatgaataagagcccttactcagatagcgttttttaaaccagcaattcccataggaagggttcctgcctgttaaagagctgcagcatgtgtttgtgcaaggcactgtcccttcctggtcagtcactggaaagagccatgtggctccagcccattgagaccttagctggggagtggaagaggtgggtggccttgaatgttacaccacatggttggagctctgggttttcctttgtttcagagtacagagggaggggcccctcctttccctgcaccagtgcaaggagaccttttcctatcagagaggacttgggaagggccatggctcccctctaatgattgctggggggtgggggtaggcgtagagtttgaaatgggcagctcccttatctcttggaaggttggaaggtagtctgaagtcctcattgtacctacaggatcttttttatgtcattagtttggtcagtgctggaggtgccctaaggggccttctatccacttggctgcaaatattggtaggtttattacagagatgggggagttgactgattgatagcttcagttgaactgggattgagagaggtgtggttgtgagttattattgaggtcttggcctcttgtcactgttcataatccaggcctgtttttgtaaacaataggccactggcctccatgtcctgtccagatgcattgcatttgctcttggaatcccccctgcagttttaaccagatatgtctttttttttttttttttttaacacatcctattcttaaactgttgccatcgggagtgttaataactttgatcttcccagatttctctccagaagcacgccatttgactaaggtgcaaagtgactttaaatgtttaatttttggaaggttcaaggctgataggtgttaatagaaccatatctgccaatttcttattggcaaaggatttctcaagagtgtctcaaaattaaacactttggatatttacaaacattgctcattgagatgaggtaatgcagtcggctatttgggttctctcttcaaccttgccacaaacagactattttgctttgctctgatattttcccattgatactattcaggatcatagaattttataggtggctgagcatgatgtcttactccgagaaggtgcctgatgaatgcttatggaactgatttgaatagtttagtccttcattttacaactgaggagaatacagagaactgaagaggcttgtccaaggtcacacggctagatggtggcagatctgaaactagaagcagatttaccaactctcaattctctattctgtatctttactatgaaacatcatctgaccagggtggaaaaaaataaaaaattcttaaggagcccaaatctgtcaatgaataatgatagtaataatgataatgataatagattacattttggttgctcattatgttccagtccatcccaagtgctttaaatgaatggtctggtttaatccttacctcaacccaggaaatgggtattattgtcaccttccattcaccatataaggaaactgaggcttagagaggatgagaagcccttccaaggtcacacagccaaaccatggcagcttgacttcattcctttattcattaactatttattgagtgcttgctgtgtgttctggcgattggccatacagctgtgaagaagaaaaagtctctaccctcgtggagcttatattctggaagctgggctctctatggaacagcacagaattgggagacaaagggcctgcgatctggtttggctctgccccccactagctagaagccctgggtcagaattattatgagtgtcagctttttgtgtgttatatgggactcatggtgctgccagacttacttctcttacagatgccaagataaaaagaaaattgctgtaacagctatgcagtttggtttggttgttaagtgcaatttttagagtcaaagtgattcaggtttaaatcttggttctgccagtagctagcctttcacttcaggcaagttacatgacttgtctgagcctcagtttccttatttggaaaatgggtaaaataaaatacatttcctaagatagtagtgagttgttgatgagatatataaattatttagaacagtatcttgcacttgtaagtgctcaataatggtacggtctacttctctgtgagcctttcttttgctgaattgggctgactattgaggctgcattgcatattcactcccaaagtgccagctattaaatgataggaaataagtaaggaatgaaacttaagttctagcttaagatcatttagtcgtaacaaaacatcttgggtcagtcacttaaaccctctggacatcagtttctttttctgtcagtgaacaagtaaactaattattggccactgtggttcagcctgtctttgaccagagtcccaggtcctgttttttcaatcagaattgtttgagtcaaatggactctaaatgggaccctcatctcatgggactttctgggaccctacctatcccttgatttttgcctccctataaaccacctgcttgcatgtgccctgaggaactcctgaggcttcagccccaaccctaccccagagtggttttatgaggggtgtgcctccttagtcagcctgccttgtagtgtcttcttaaaaaccatcattgtttcaggtttgtgggtgcccacattccttggaaagttcatgcctctcaatgtctgacttgaaagcaataatattcttagtctttttacatagctctttccaatttacattatgctttcatatgtagttgtccgtcagtatcctcaggggattggttcaaggactacccccacttcccccaggataccaaaatctgcagatgctcaagtccctgataaataatggtgtggtatttacatataacctatgtacacacatccttctgtatactttaaatcatctctagattacttataatacctaatacagtgtaaatgctatgtaaatagttgttatactgcttttaaaatttgtattattttaaattgttgtattggtatttttattgttttttttttttcttgaatattttccattcccatttggttgaatctgcagatatggaacctgcaggtatggggagggctgatgtacattaatctctggaaattctttacaaccctggtcagattcatggtcataaactgaagcctttggcctctagcctgttagcttgttgctgggattggagcagcgaaggtggtaaggtgcagggcatggttaccagggttgtgaatctgggtggtatttgggtgaatacacatgactgtatacagtcccagctattgttctttccttatttaaggcccctttcctttaccctctctataccttgagtttttacagtctcccagaaagcttgagattgacagttcatgcaaatattccagaagaaatagtctgaaacagggtggcactctatgctgagcagtcacattttctttctcgagaacattaggggtcttgtctttttttttttttttaatgtcttaggagaacagtgtgtgtgcaccacagagctggaagcgaaattttgtaatttccatctggagcattttgatagaaaaagtgcaggcctttgcttggaacagtttaaccctttcaggacccttcaagagcaggagatgaaatttaaaactggagtcgtattgtgtatgtatatatacttgggaatgttgatggctggtatataaacaagctctttcccttgggaggtctgagcaatttttcattcatgccaacaaaggtcttctccaaagcttctttcctcacagctcccattccccaagggagctttaaatataatcagttaatcagttttaaatataatcagttaaatatagtcagtttgaaaagctgcagtaaaacatttagttggaatcctcaagcagatgctatcattttcctgcaagatgattgagggctcctgtcccttgctcaggggaaaaaacaacaacaaaaaaagctactctgcagcagtaaggtgaactcctggaagaaaatgaaactcttggaaactttcaagtaccatactctgcatcttgcaattgaaagaccctagaggaacatggtaggcaaggagccaggggatgcagtgtactgtgcaaagaagcagtagttggaaacagtgttcatgaggggtccttagctttttcaatttcaggtgttcttggggaatgagaacagaaatttcctttgaagaagcctatctggtaattgtggccacatccgttatgtatcatgcaggttgaaaacttagacaggctctgatgatttctctgctatgaggtgtccagagatggacctggctgcagtatgtaggcgccctcactattaaaatcagcaggtacccagaccctgactcccattattcactccagataaactgggctacccagtggcacctgtagagttgtccttccagaagtgagaatgcttcatgggaattgtgcttaccttatacccttgacctctgacagctacattaggaaaatatgtcatattgcagggaaaaagcagttgatatgtagatttctggtagtaataaaattagcagttttaacctggtgtcagctccagaattgactttttggggaatctgggaaagttgccttggaagttgttaggtttaaacataagtaataacagcacttaaaaacattttaaaaaattacaaaattaacacccttactgattttacaataatgtgtaggaactctcatatctcccttactctctctaattgtggtagaatacacaggaggttgaccatcttaaccattctagagtacagttcagtagcattaagtacattcacattgttgtgcagccatcactaccatccatctaaatgactcttttcatcttgcaaaactgaaactttatacccattaaacaacagctccctattccctcctgcccctgtctctggcaagcaccattgtactttgtctctatttgataactccagatactgcaggtaagtggaatcatattgtatatattttttgttactggcttatttcacttcctataatgtcctcaaagttcatccatgttgtagcatatgtccaaatttctttcttttttaaggttgaataatatttaattgtatgtatataccccattttgtttacccattcgttcattgatgaacacttgggttgtttccaccttttgcctattttgaataatgctgctgtgaacataggtgtaacataggggtgttcttttttcttttcttttttttttttttcagatggggtctcactctgtcacccaggctggattgcagtggcttgatcacggctcaccgcagccttgacctcctgggctgaagtgatcctcccacctcagcctccgaagtagctggggctataggcacatgccaccacacccagctagttttaaaattttttgtagagatgaagtctccctacattgcccaggctggttattttttttttaaaaggtacactataccaaagttttacaagcctgtatatacatttctatataatcacttgtcctgataaattttttaaatttaaggttttaatatgtgcattagcttgtatattagtatattattaattataaagttgtacaccttttaataattacatgaattactaaacttttaccatatttttaatagctttattgagatttaattgacatttaataaattgcacatatttaaggtatacaatttgataggctttgacatatataatacccatgaaaccagcacaatcaagatagtgaatgtaatcattacccccaaagtttcttcattataatgtattaataaaccagtactattggccaggcacagtggctcatatctgtaattccagcactttgggaggccaaggtgggaggattgcttgagcccaggagttcaagaccaaactgggaaacatagtgggaccccatctttgcaagaaaaaaaaacaaaaaacaaaaacctggctgggcacggtggcttacgcctgtaatcccaggattttgggaggtgggcagatcacctgaggtcaggagtttaagaccagcctggccaatatggtgaaactctgtctctactaaaaataaaaaaattagccgggtgtggtggcaggcacctgtaatcccagctatacgggaggctgaggcacaagaatcacttgaacctgggaggcagaggttgcaatgagctgagatctcaccattgcactgcagcctgggcaacaagagcgagactccatttcaaaaaaaaattatctgggtgtgatggcacatacctgtagtcctaggctctcttaggatgatgaagcaggagaattgcttgagcccaggagttcgagattgcagggagccatgattgattgcaccattgcagtctagcctaggtgatagagctaataattatgttatagaagaggcattaacttcaagataactaagtgaaagcctggtattaacaaattttaaaaagtaacaaataaataatgatctaagctacccagattagtttctggaaaatttgtttaaccaagacaatctccaagggaagtcaggctaataattgtgtctcagccattactctgcttttaggagggaaggtacaggatggagtgagaaagaaaagaaaaaaaatcatggccatgttaggagtggacaaatgacagtgtctgtttccatatagagttggcttggctgggtgtggtggcttacatctgtaatcccagcactttgagaggccgaggcagatggatcacctgaggtcaggagttcgagaccagcctggccaacatgccaaaacctcatctctacaaaaatacaaaaattagctgggcgtggtggtgggtgcctgtaatcccagctactcaggaggctgagggaggagaatcgcttgaatccaggaggcagaggttgcagtgagccgagatcatgccactgcactctagcctgggtgacagagcaagcctccatctcaaaaacaaaaaacaagcaaatgaaaaaatagatctggcctgaactagtcctagggcctcatgcctttttagaaggggtcacaaataagccagatgtcaaggagaggggctaggggctcccactggagatctactcagaatgttcttaatatggcttctttcttctaatgattgactccctattgcctgctaaatacagaccaactttctaaggtagacatgaacttcattctcaatctgactgcaacctattgtttcgaccacatttcttattttgctttaagaggactggaagcctaacttgactgcttaccattctttaaacagactactagctaacatttgctgtctgttggatgtttaccacttactaagcattatgctaaatactttatatagattattccataatccttactccaactttaggaaaaagatgttactagtatcccattttactgatgaaaaaagtgaggtgtaggacattcagttatttctccagggtctgcagctggtgaataatggaataggaaccttggttgtcgccagagtctaagttctacgtgttgctcatgaaatgcccctttttcgctgcgcagtcccgtatcttcacctattgaaatctcatcctgctgggggcagtggatcacctgaggtcgggagttcgagaccagcctgaccaacatggtgaaacgctgtctctacttacaatgtagaattagctgagggtggtggcacttgcccgtaatcccagctacttgggaggctgaggcaggagaatggctggaacccaggagttggagtttgctgtgagccgagatcgtgcccttgcactccagcctgggcaacaagagtgaaactccatctcaaaaaaaaaaaaaaaaaaaagaaaagaaagaaagaaatctcacctttctggtaaagcccaacgtttctgggattccttccttaattgctctgaccagaaataacccttctctctatttcacccacatagtgcttctcttaatagatctcatatggcattgatctcatactgccttatgtttggaatatttgtatttcattcttttttcttctaccagacttctgaatgtaggaatgttttgaagttgtgtagtgcaatgcaaagaatacaggctctggaaccagccctcagttggagtcttgtcagcatcacctccttgctgtgtgaccttgctgaagtcactcaacttctcttccaagcctccttttctgtgatgtggagataatgagacctgccttgctattaattgcagttgtgttaagagtactggctcagtgtatggcaaatattaaatgctaaataaatagcttattataaggtcccttcagataggaaacgtgtctggaagactattgtagctcaaatggtggctctcagtaaacacttattgtctgtagtactgaatgaatggatgacctaactactacaaataatcttttagaaatagtttaattgtatcttgacactgtatcttgcacaatgtcaccagagtgatttttaaaaactcattttttttttgctaacatcgtagcataaaagactgttaatattaatcacttcccacttaccctgcttacattttatactgccttacagctgaactgcctctagtttcctttctttatcatgttgtgtcatggtttgtgctgtatccatgctgtgccctctctttggaatgggtcctcttccttgaacctgtaaaacttattcatcctttaaagcagctcagatgccacccctccaggaagccttccctgctcccctgtgcgggatcccaagcaggattcctcagcatctccccttgccttctgcacagagttcctcagtacgctctcagcatctcctctgcagtgtctttgtacactcttgtattattgcactcatcatattacattgcgatctcttcatttacatctctttgtttacaactcactgagcaccttcaggaaagaatggtcttttattcatttctgcatgtccagctcctgacacatagtaagcactacaatgtttataagttgaattgaactgtcttctgagttgagtttggatgtgatagtgccatgatggcacgcttctgcatttctccccgactccagtaagaaacccatgccctatgttaatattatttgaaatttgatatagattaaactttgtgaatatatttgcattatacaaggacaagtacaaactacatagccttatggatcctcccccacgggggtgtgtttctccttaaatttattgctggcacagccctctttagaatcactgccctctttagagtcactgccctagagctatacttgctttgaccaaatttcttcagtcacatctctcaccttggaaaccaagaaaaatgttaacactgaaattcccgagagtttaaaacaaacataaggctttctgtaattgaagcaaaaacacattgtacatttgtccaggatttattcaccattttaatcaggcactaaaagtctaagtttgagaaagtttgtctgtcttgacctggagttaaaactgggttgacctgaaaaaggaactgttttgttcctttttcaaagcacggtgtggagagagctattgcctggttagaagcagctgtgagatctttggtaaatggggaaggagaggtcctaaggaacaagcaggaaaatggtcccttatggtttttcaagtcatttggtatgaaatagccttgaccttatttatacgttgtgaatgaatggttctgaacttgaaatatgtattcgtgaggaaggaaaaacagttgggacatgttcctccattttggtgtatattttaggatatcatcctttaggaagaaggcatattctctttgttttttttgtttgtttgtttgtttgtttgtttgtttttcttaaccatatcttctaaatgcattaatcagtggagaggtgacccagaaatcactgtgaaagttgggaccttatctttgctgtttgagcccagatcttgcatttagaatcatggcatggtgggcaggatctgaatactctccctggagaagatgaccctggcagccatgggtggctgggtggccagggctccacaggaggacaaagcacagaaaacaaagggacttaagagcatgagctggccatgacaagccatgccataagctttaagaaatatgtcttgtttctgaagagttggctgttgccaactcttctccaaacattgaaatcccttagaaatctgcttcctttccccattagattttgtgtgtgcgtgtgtttattattttggtaggcggtggagatactgcaccagagcttgtcagatgagtaagctgctctctgggaagacatcttgactgaggtacctattctggagcaacatttcttttgggccaatacagtactttgttacgcgttgagctacaggattctacacaggcagaatgatcctaagggaaagtgctggattgggaggcagaaagcttgggttctagtttagctttgtcattggctcccatgattttggagataactcacctaaggtctcaaaatccctagtttccctataaaatccctgtaagatgggaacaacaattcttggcccttataataatgatgatgatgatggttagcgtttatcaagtgcttcttatgtctcagctctgttttaggtgctttacgtatatgaactcatgaatttctcaacagtcctgtgaggtagctgctattattatccccattttacagatgacgcacagtgaggttaaataacttgctctgaagcacatggctagtaagtgatgaggacagattatgaacccaagctgacttaacactggtgtgaagctgaaatgaaagaattcagttgaaactatgagatgctgtacacactcagttgattgtcctcatttcctagtaacttggtacaataaagaattaatgcagtgttttaaatgtctttctgttacatacctaccgtacctccctatgccttggtattctcatctaaaatactaggggttaaacattagaaactttcctaggtccttccagctttcagggttcattatttttgcttattaatacgttgaagatcggcctggctgggtggctcaagcctgtaatcccagcactttgggaggccgaggcaggcggatcacctaaggtcaggagttcaagaccagcctggccaacatggtgaaaccccgtctctattaaaaatacaaaaattagctgggcatggtggcgggcgcctgtaatttatcttagctacttgggagcctgaggcaggagaattgcttgaacctgggatgcggaggttgcagtgagcccagatcgcaccattgcactccagcctaggtgacagagcaagactccgtctcaaaaacaaacaacaaaaaagatgttgaagatgatgatttgtcccttttaagtagacacactttgaagtacaaaaaccattatattctctgaatgacattctttccacccccagaacttgccatgcctgcatggctgctgcacacttatggagggtaggccccaggtggtaggtagtaccagagtggcagctggcctggagagcagttgaagtgatacttgttgaagtatcatgatctaataggaagatgtgcctcacagctggagaaaaatcgaggggagagagagttacttgatgggcctacaggtgaacttgtgactggatcactttaatcaggatgttttaatcaggataactattaaactttggacttccagtaagctcagagacttctagagttagaaaattccctgctgtaactggtttgtatggttttccccatccatgttggtaggtcagaaatggaatttgtgtaactgttagtattacagatatttatgttgttgtgtgcagtacttaaatttaaaagaaaaaggaagttgattgattgtccttaatgaaaattaaagaaataaggaagtgggaggctcttaatctctgacatctggtctgggacaaacctgggggaggcagtgtggttatggaactggtatagggttgatctagacatctgggttgttcgggaagtgacttcaggcccttttaggatgtggagtggcctcttgcctcttacattgctctttatgtattaggccttttgtcaactaaggatttctttgaggattgtgatgaagcatgctgtaatgtggaattgaaatgttttcatgtttatgtttgttttcctttcgcctaatgaataggctagtaatagtctgttgttttaaatgagtactattaataataatgacagctcatatttttatcattacagcatttaaaaaatatcattcatagggaggaagaaatgtagggtaatggaggaccagctatgtaatgttgaagatgtcattccacctttgggattctcagcttctcagctggaaagtggaaagatggattactagttcctagcttcatgatttttaggacatatgaacaaaaaatggctattgttaagtgagttgtcacatagagtctagatgttgattattgtcctgggggaaggatagaaaccagagaatagatagcacaggttcttcctactcccctcttctacttctggtttaaggtttcatctttttttttttctttgttttcttcttaaaggtttcatctttaaatgacattaattaggctttgtgtttttagccatttttagagtccgttgtgctgtatctcctgatctctctttttcagtgatttgtggttatgtaagttatctcagttctttgctgtcagcaattttaaatcaaacattgaagcattttgggtagatgacgtgttactttgattaatgaggttcttgatctggatattttaaggccagtaacaacacaatatggaaacacctaattctccttaaaactgcaatagtgttctcactgccaaagctgaaacctatttgtgctggttacttctttctaagagtgaatgtgtgcgtatgagctttcttttgctgttttggccagggagtgggactgccagtccagaaaggccagctcttctggattcagtagcaaaagagttaatcattaagcagagacagaaacctcccaagtttctaaccttctcttgcgttaaatctccttactcttattagaagaaaaggcatatgcacacttatgcatgcgcgtgtgcacgcacgcacacaaacaccatacacacaaatactctaacaaaacttaatgtaaaatgatctcatgtttatgagagctggaattacttgggagggatacttgtgttctgcaggcttagtgggcacgatgtgaaagcaaggctatttggcctgtggagattgaagataagagcgtgatatgtaattgagtaagaatttgaaaaattatccgataacgttaggagcagcaaagcaactgcttgtacttttttatgcttgaaactatttggagtaggagtgaggagctagcattgttttcagggcatgggaaccccctccccacctcactagccaaatatgtttgcctgggccgagagtgtcagatctctgagagatcttgacagagtatttaaatacattctgccctcggacaattcttcagtgttaatcatttcaggaaaagggctgtcagctaacctttaaaatcctttccagaatagtataccacagcccacctttccatcttgttccagtgacccaatctataaatggtcagttccttcatttgcagaacttgaaatagtttaaagaagagacttgatgaattgaactcatgtttttgctgctgtggccacaccctctatacagacatttgcttcatttgggttctcagcaacttgggaaggaggaggctattgatgaaactttcaaggcgttggcttatagctactggagtgttcttctttcctgtcccctcccctcctcacttcctccagtgttgggacactttgtattgaacaagaagatcatgagctaatttcaacctggcagccatttatttagcacctactgtatgttgtcttttttttttttttgaggcagagtcttgctctgtcactcaggctggagtgcagtgatgttatcttggctcactgcaacctccgactcccggattcaagtgattctcctgcctcagcctcctgagtagctgggattacaggcacgtgccaccacgcctggctaatttttaaatttttagtagagacagggtttcaccatgttgttcaggctggtctcgaactcctgacctcatgatccgcctgcctcagcctcccaaagtgctgggattataggcgagagccaccgtacctggcctatatgttttatactatgctaagctgtgggcatagagagatacagaaaaaagtttctgccttcaaggagctgcagtctattagaaatgtcttagtccgttttctgttgattataacacaatgcctgaaactgggtaatttgcaaagaaacaattttttttttccggttctggaggctgggaagtccaagattgagggctgaatctggtgagggccttcttgctgatgggaactctccacagagtcccaaggtggcgtaggatatcacatagagagggagctgagtgtgtaaacttgccagctcgggtccctcttcctcttcttaaaaagccactagtttcactgccaagataacccattaatctattaatccattcatgatgacatgccttcatgatccagtcacctcttgaaggccccaccatggggattaagtttcaacatgagttttggaggggacattcaaacaatagcaagaggggtgatcggattacacaagtacagtgatagggtcatagtagagagatatcgaaggctctgtggataaggaatagtctaacagtgagtaatgctgatgagactggttgatagaggaagatgatgatgttacctagtatttacagggcacaaggcagtcaaagtgccttgccatactttatctcatttaacctcagaattgtacaacacagggcaggatgatatccggcctttttttttttcttttttttaatattttattttgagataattatgcattcacatgcagttgtaagaaataatgcagagagattgcacatacctgttacttagattcctctgatggttaacatcttgcaaaactataacacagtatcataatcaggaccttgacattgatacagtcaaaattctaaacagttccatcactgcaaggatcactcatgttgtccttttctagtcctgcccctcccagttcactctttcatctcaccccactttagtccttagtccttaactgctggcaaccactaatctcttgtccatgtttataatattgtcatttcaagaatattataaaaacggaaccattagcatgtagctttttaggattggcctttttttttcactcagcacaagtgtctgaagactcattcaggttgttgtgcatatcaatagtgtatccctttttattgctgagcagtattctatggtatgaatgtatgatggttcggacatatgggttgtttcctattttaggctgttatgaatgaagctgctctgaacattcattatagatttttgtgtatacaggtattttttagaaaatagagataagccaggcatggtgatgtgtacctatagtcccagctactctggaggctgaggcaggagaatctcttgagcccaggggttcaagatgagcctgggcaacattttggagatcctgtctacaaaaaaaaaaagatggaggtagttttttgtaatggcaagattgtacattagaagatagaaaagtaggttttgcatcttactagggaagatacatgtatatttctctccctttggactgatcatttaagttgtttcaatttccttatcaagaaactggcataatatatgttctgcctacatcccagggtggttgtatagataaactgagataatatatggcctcctcccaagtaactgggattataggtgcgtgccaccacgctgggccaatttttgtattttcagtagagacggggtttcactgtgttggccaggctggtcttgaactcctgacctcaagtgatcttcccaccttggcctcccaaagtgctgggattacaggtgtgagccaccgtgcccggcctcagagtagttcttaaattgcaatctagagacaactcttttaggccatcttgctttttctaataattgatgtgtagatgttccttttatattctgtttactcattgttgacgattataggttgcaatacctgctcccagatttagtttatcatcttacttttaattgaattatttgatatataagaaattccaagtccaagcatggtggctaacacctgcaatcccagcactttgggaggccatggtgggaggatcacttgagtccaggagtttgagaccagctgaagcaacatattaagactctgtctctaccaaaaatacaaataagttagctgggcatggtgatgcactcctataatcccagctactcaggaggctgaggtgggaggatcacttgagctctagaggccaaggctgcagtgagccgtgatcatgcctctgcaccctagtctgggtgacagaaggagaccctgtctcaaaaaaaaaaaaaaaaagaaagaaattccaaatttaatatagtcaaatttactttttgttaaagaaattaattttctttactgttttgatttatttaaaagacaaacacacacaatcataaggatattcttctatattttcacctacacattttgcctttcacataacgtcttgaataaacaaggagtaaattttcgtgaacagcgtgaggtagggatctaactttattttatattccatgtggctatatttattaaagggttcatctttttccccattgatttgtaatgtctcatttgtacatacattaagtttattatacatatttgtgggcaagatgagttctccatcatgctgtagcggtgctgccgctggatgtgcatcaggggttgctgatgagggagtcaaatattttcccctttgaggtagcagcactaggctgtccccacagctccaaccagaatagctctgcttttatgttcacgatattgggtgtcccgctaagattttatttgaataactttttagatggaacaattttaaaagttaaaaactaccatttttaaacaaattacattttggatcgttttttgagatagcaagggtttcgtctctcatcttgggttggatgaaaagtgtaagacaacacagaactcagaacctagcagcgagggaagtgcctgtttttcaaagggaaaggaatgtgttattttgcagttgtcagtagttccaaatatatcaactattccacaaaataatgagtatgtagtttccgtgagagacttagaactgtctagagcctagtccttattgtctgtgatcatagaaaccatggagaaaaaaagcctacctatacgaaagtagttaaaaaaaaaaataacccacagcaatacaagaaatgacatcagccagcagatgactgaaaatgagtggtgttgataagaacttgaggaattttgagatgggagaggtgtgggccagaatgaataagaccttgatttatggactaggatttggctaagtcgatagtaggaggaaagaacagaggcagtgtgtcttccctcagtggagttcccacagcccccaccgtgcttaccgctcctgcatcacttcctacaccctaatacaatgatggttttatccaccctcacccccacccccacgctccttcccccagactacactcactaccagaaagcttgtgagttctttgagggtgggcagtgggcagcctgtcatttcaacattcccagcctcctgcaccatgtttgcatgtggtaggcacccaataaatgtgtgctgagtgagggagtagactcttgggctggagcagaggagttatagacagaggagtaagatcgaactggatagtttttgatgaccttgaagatcagccagagtctggcttcatactggggcaacaaagaacagtgggggcactctgagttgaagagtgatgaagtgtgatgaagtcatttcagagggactccctggttgctctgagttgcctggctgggggcaagaggcttgttcctgcccacacagcataccaggccttgtggtgggtgctgcaaacatgctgttaaatgtgatcaattactggagtcacctgtgagggaattgcgagtccccatttactgaacaagaaatttgagtcaggcagatgatccgaggtgatggtgacccatgatggaatggggactgcagctcaggtctgtccaactctaaagcctgctggttcttttatcttggatcttatgtttgaccacactgtaatcaggagataccactaagatgggaagatgagctgccgagatgggtgtggggcctaggggtgaagtaagagtcaggaatgcctgaggtttttagtttgggagacagggagaacgatggtggcaatggcagaaatagacatatggaagccaggaagaggtgcagcagttggtgagagaatgagcattattttagataccctgagtttgagatgacagttccattcaagcaggaatttcattaggcaagtgacaatgccacccccatccgcctttcattaaatctgtcattttcttttcttctaaattgggaatgttgcagagaaactgtgaaatagatgacacccctcttacgtgccaaatacctgacctccttttgcagcttcttacctttcactttcagaaatattctcccttgaaggggcttcgtgtttgtgtgcaggaattaatagcattttctatccctgtgccctgtagggaaagagcacagctaaacaaggagagagaaaactggagttctgagctgccttgctccgagtttggttggaggccccttatgagggtcagctgggaatgaaagaaaagtcaagtcaagccctgccagcaccctccaccacctgacctcccatgggtgactgaagagccagctaatgaacaagttcttttaaaggcagcctggggagtgtgggagaggctgagttcagcaaaacatgactaggtggtgctggtgctgtttcggggtgtggaggcagaagtggttgatctccttaatttgaataactttggaatggggagatggtgctttgatagaggatttgattggagattttgattgtaggatatgttgaaagaggggatcaggctaaagccatttataggaaattatatttcagatattggcagttgaacttaatgtattctattctcacttccaaaggctttgaatttttagtgttatttctattttgaggagagtggcctatgagtacttctcatccaatgtgttcaatccaaggagactataggagttattactctcctcctttataaattctttctgtgtaacagagattacccacagttggcttgagagttttacgccacagtttggtagaaaaaagaccactcagctggaggtcagaggcttgggtaccagtggtagctctgacccttgccatcaactatgtggccctgggtaagtctctaacctctcctggcctcaagcctcttcagatataggatgaacatataattcctacatctaggagttgctgtgttgactaaatgaagtaatgcttgtgtatcagctttgcaaattacataccccaaacaaatatatattaagattttatttgctgcaacagaagaaagtggaccatctcttggtgtttgttttgatgagacttgacctatataacacaggctcaagtatgtttgttaaagtgaatcacctgttgctttctgggccatacttgaaatgacgtgccgtgttacagtgaaccccttttgcaccgccccaagttcaggttgcccttacacaatttgggcgagatagatgaacacgcaccttcctccttcttagaaacaaaacagtgacttgggtagggtagacattaggaaagtgacttagctggtaaatatgtgattaataatggagatttggcctaagcatgagtgcgagcctctgaatacggatgggtaaatgataaatagcaagtctgccaagttgagcacattggggaacctcttgggctctgttcatgcttgaagtatgactgtgccaatactgtactcgctatttaacaaaatgaggtcataccaatcacactattttgcacgtatttgtttacacatctcttgtctgctaagctatgagctctttgagagcagggactgtttctgtttatcgttgttttctagcatctagcagagtgcttagcatataataaatgtgtattggatgaatgaatgaacgaatgaaattctttgcatttttactcggttagagagattttttgaaaggcatatatgtgggattatttgtgctgtcatctgctaatttcacagatgtcttctcaactgtagaccttcatataagggaaagacctatttacgcatagttgagttgcagctgctgctgccctggcctgatggcacagtggtgagggctgtctcaatatctgtcccatgtctctttcatagaataataccctccctcagccccttttccctgtatcttcctttcaagggttgctgtgtagttaactctgcctcaggcaatttatcttatctgtacttttctcttcctcattcctcttctcttttccagtgcttgtccagtaacctcaaggaaatctgttccaacccttctttgctgttggtgtattcctattcatgagttaaatcccaaacaaaacatactctaatcagggcagtcgaacttgaaaagagtcagtgagaaatctgaaaggaggaaaagcctggccacgaggctccaagtgaaatgaaagccataaacaccagcttcgtcaaccttgaaagcttctaaaagtgcccctaagcctccttttgaatcactaaaagttttcacttacctccctgtctttctcagataaaatttcctctttctcagccatgagtcttaaaaaacaaagcaaaacaaaacacttcacacctgcttcttattcagttttacactagtggaaagagaacgggatttagagttggaaggccaacgtgagcgtcctgctgccacttagtagctgtgtgactctgtataagcttctaggctttctgtgcctcaatttcttcaaccgttgacaatatgaccgtgtatcatcacataatacactatgatgtgaagtttatgtagatgaagaactctttcaagctcacaaagcaccagatacatgtcagatatttctaatgttacaccagtttttaatatcatgtttcatttcacatacggtacttgatatctcaattacattagaggctaagacagttttctaccagcatgagaactgaaacacgatagcatgccttttatggcgaaatgtgtttgaacttcaaacaacaaatatataaaacttattatgcaatacaccctatcagcaaattaattgaaggctgcctctagattgttaggtgtggacgacaggaactttatttcctacttcttttgtacatgccattgctgtttaacagtgttgggttcataacaggtgattagacagtcttgttgatagtttggagaaccatcttaatcatgacctagaatcattcttatttcacagcaacctgtgtcttgactaatgttaaactgactaatttgttttgaagctgagaatgagaaattggaggtccttctcatagatctgagattcctttttattcccgagttggataaattagggtaaacaaaatcaaatacttgtaaaaatactgtacaaaggaatgacatatgcatgctggttccctagcagggtaattccatcagcgctttaaaaaaaaaaaaaaaaagatgacattccttctcaaccagccaaaggagccattttccaatctcttatcttgttggggtgtgttagagaaatataccaagtgcaagaacctgtaagcctggggttcattaacctgcttaaaaccagttttacttcaaataggcgatctttagtgtcaaccgttgtacttttgtctgcagggaacaactcaagtttcgtcctgtcctcagtaagcagatgagaggtagggttgacgttagaagccaagtttttgtggagcaataaggtaaaattatgaaggaagcctatagaattccaggagagtttaaagaaaacagtagaatactttcttagcaagggtatgggtgggcttctgagtggaggaagcaggctagaccttgggatgttccagtccaaattctgtttcggaagctccctaaatgtatgcagaggttgtgtaattgtattcatcactgttgaatgtattattggtttgatttggtttcactgctcctaagttccttttgtcttatcttgcaagcatatcactgtgagtacttaaatcattaacaactcattaaaactcttgaccattttcattttctaccaagctgaagcctgggtgtggtggaaacttgtgcaggcctgcttggctgtgccgcaactgagcagctcctagcagtttggctgtcaaaaggtcactgaataaacaaattgataggaatggcggacataatctctgcagttccttgaaaagaaggaaggggctgcaggatacaggatagtgaaggatccttctcttcaacctgaaagactcttcagcaattaacaccttgactctctttttatgcaacactttttttttgtcctctcagagactctatttgtacttggtcttttcttctttcaggatttctatagcttcttttagagactcaaagtgcttccagttttgttacctcatttattctctaggggcaggaattaaggtcttgatggagatgaagtggtacatcacttactgggctgtggaggcagtctacaacaggcagttgcagcagttcttctggttacatgttgagagagagatatatatatacacatacacacacacacacacacacacacacacacacacacacacacacacattttaccttatttaggatctcccagaagataattttaactatttgtaatttctatatattttaaatagctgatttatgcctcataagtaaagaaaaaaggtttctctgcttttgacttgaattgttgaactatttgtcccttggtaaactgatcagttgccgtgcagattgagagaaagccattcaatcaatcaaaatgtttctactgcattggcatgctttgtaatggaaatgaaaatgacagcatgtttttgtcagtttaaatgaataggtttcctttagatcgatgctgaagttggtattataggtatctagcctatgaatgctaataattaattacggaaatgcctcatggaagcacttgaacttacccctgcatcttacagatatatctgcctgttggtgaagtgtatgccagcgttgacatttcttgtgagtactggcatgacccatgacacagcctctgtggtaccagagggccctacactgtcttcagagacattcagttcagtgcattttaaaaaattcattcattcaatcactaattcattcatgtactcaacacatgattatgtatgcctactatgtaccaggctctggtctggtgctagagatagagttattaacaagactgaggaagtccctgctttcatggagctgtatttgttttttttttttttttttttttttttgagacggagtctcgctctgtcgcccaggctggagtgcagtggtgcgatctcggctcactgcaacctccacctcccgggttcaagcaattctcctgcctcagcctcccaagtagctgggactacaggcgcccgccaccacgctcggctaatttttgtattttttagtagagatggggtttcaccatattggccaggctggtctcaaacacttgacctcgtgatccgcttgcctcggcctctcagagtgctgggattacaggcgtgagccaccatacccagcccagaatggtattcttaacgtatggacttaaaaggagcatttgcaaggaagagtggcagtggcagtattgtatggggagctctgattctcatttatgcaagatatgtaatgcctttctaaagaatagtgttgctacttacagctcgggcttggagataagacccactactctgcaggtccacttgaacttctttgtaagcccacttgaactaatctggaagagtttcaagctttggtaccctatttgccaacagctgggtacaaaaccacctattgggtatgattttagggctattgtcaaggtccctgaaggtggatagactgaagacatctcttctactggtagctttatctctttaaaacattcttttattgtatctcactcaaaagactagctgtttatttatactttagtatgagattccatttgtttctttacaaggttttgataagggtctaagactactagatgccagtttagtgagggagggcactctgggggaagtaagcaggtatatggggctaaaatcaaaaggttgaagcacctccagtttgacctacttaacaattttgcttagccttgaactcttggcttctctgataattagttttctaatttttttttttttttttttagacagagtcttgttctgttgtccaggctggagtgcaatggcgtgatctcagctcactgcaacctctgcctcccaggttcaaatgatttttgtgcctcagccaccccggtagctgggattacaagcgtgtgtcaccatgctcttgtaatttttgtatttttagtagagacagaggttcgccatgttgggcaggctggtcttgaactcccggcctcgagcaatccacctgcctctgcctcccaaagtgtcgggagtacagatgtaagtcatcatgcccggcctcgtttcctaattttaaaaatgaaattgttggagtagatcatcacaatcccttttagttaagtctgctcacttggtagatttgtacctaactgcccaactgcccaggctttggtgtttttccccattctgtgctttggtgaggagatcctgcgttttctttccgtttcctttgccagaaagagctccctgtggcaacatagaaaatatcaactcactgatttccccagaaagggaagagtccacagcttcagaatggtatctgccctggtgtctgcattctggtcaggcggctgcgttcagcgtctgtgctcccgggctggggtgcttatctgtagtagccagacggcctgggcgctcacagtaagttacgtttacatagtggagaggtgagcaagcagatagtctgaagcaagtagaaagaacactccagtcaaggttttccagaggaaagattttgaaccatcgtcaattaaataaaacagaatcttctcaagatcaccagaaaatacatagccagggagatcccaagtattgtggaaccaagctaattatagttacctcctatttgcttagcattttgtgcttttaaaaatgggtcttatttcatatctcatctgatcttaaatatcctgtgagctaagcaggtcagaaattatcattattattattttttgagacagagtctcactctgttgcccaggctggagtacagtggcatgatcttggcttactgcagcctccacctcctgggttcaagtgattctccttcctcagcctcccaagtagctgggattacaggtgtgtgccaccatgcccggctaatgtttgtatttttactagagatggggttttgccatgttagccaggctggtctcgaactgatctcaggtaatccaccagcctcggcctcccaaagtgctgggattacaggcataagccatctcacctggccagcaggtcagaaattagtaatcccatttaaaatatgagaaaactgaagcattaggtaggctaagtgacatggccaaagtcacacagttaatagggcaggatcagaatttagaatgcatgttttttcttttaaaaacaactttattcaggtataatttatgtgcaataaaattcactatttgaaacctatagttcaatgagttttgacaaatggtatatacttgtgtagccacaattataatcaataggttgaacatttctatcaccccaaaaagtcccttcacggtccttggctttaatcttcctctttccttccccaattccccctgtcttttgatgtctaatgcaatgctcttttcactgtcccacactcggacttgacagcccttcagccatatccttctggagagagtcctggctggcagccagcctgcctcatcatgttgagttatgagagtgaatgggaagttagtgggttgcttactccattgttagttccttccttcccttcttttaccagctccaggctatagaaaaattatgtgggttctccttcccaggagagcttgaaaaacaggacaccagctcacctgtctgctcttgcttcctggtagcctgctgctggggaggggtgggagtgagcaggaggtggtggggtggtggactaggcgacctctagaggatgctctacttctgtatcgtctgctcagtctcgatctccttagaaaccagctagctctctgctgcctagttgcagttctccaaggctttaagcagtctgaattccatatctgatgaatgaatcccaaaggtgttgaagatcccagttctgaaaaatgagcaaaccccaagttttataattgaaactttcatagcagatcgggtcctagacagatccctccctctgtaactgagttaggttttgaggggagatatcccccattatactgttcctaaatcctagattttgactgtagtgttcgggacattccggagagtcacattgtttacccaggtgctggaccagagttgctccccggcgttgctgtgtggcatccagcaaaggcaggttgggagcctgctccttttcatagccagctttgcctccataccagcaagatggaagataggtgccttcactaagcccctcaggtggccacaggatatgatccagaatggtggtctctacttttctatttgctcctatttagccacccagtttgggagtagccctgtgtattatgattatctctttcattcattttgggctatttgagtttttagggccctttcctatccgttatctcctgttctcaataagtctgatatcttctgttagagtaaaagctctatctcctctgatctaagacagctgcaaggacaggacagactcagatttcttctctgcaaaggctcctgttaaatcttgggccctatggtattgattttcttctagttatctctacaaatttttctggctttgctgaagggggaaaaaatcaccagactgcatgcttgagcttcaggtttctccttagctggcagcctcaaccagaaaaaaattctttttgagagcactgagcctcaggcactggttttgccctgtactccccagtgtctaactcttaacagctggtggccatccctggcctccatctttactttgctgcatacctcagcttgatgagtccttgatgttgattccttgaccttactgccatcttctttcccctgcaggggcctcttgaactatggggagcttagtaaacagtgggcttcctgtgttttgtctaccagcaaagctgggtacctgaatccccatgtgacagtgctgcatggctgactccagtattcttcaggagacacagtagcaggaacagagacttagttgaaagccccaagtgtgtatatctgaagtgtttgtacaaagatgggggcagagagctgctcatgtctgcaaagagggacagtcccactcttgcagaggtgacagtccacagcaatgctgtctcttccatttctcattggggttaggtttccaaaggtccatgaaggttttattcgttttcgtgccccaagagagctttccatagtaatgaaagaaatgttaagaactgcaggaaatgggtaagattatagatggccaaggaaagtggcaaggaacaaaaaaagacaatgtattttaaaggaaaactttttggagctatttcatggatgctgctggtcacctggggaaatcttggatttatttgacagttcccattttccacttaggcttcatgtatacatgggtttgggagctaggaaggggaataataccctccccaaagagctgtggctgagctcccagtccccaggaccaaattgagctgttgcagctgggaagcagattggtgcagccctccccaaaatgctcacagccctgtggttatttcctgtgtttttccccttgtatattcctctttgcagcttgtatcttccctttctacaggaaatctcagccgcctagcccatgggcctggttgggctgctgtctccttcctttattcttcatagcccttaatcacttctcattagtggactccctgggagggagggaagaagggttttgttctgatgccggcctcctggaagggctgtatcccaccaagacagatggctgcctagcctatttttaactgtctctggggaagaagattccacaacctattttgaaacctgtttcattgattgacagctttccaattaggaatttcttgctgatacctgacttaaaatttgacagctatagttgaaactcatttccttttgtttctttgaaatcatagagtttgggaaagagagggattttaattagaagtcgtctaggcctacccctaatgaagaaaataagttgaagttgaaactgaaaatgcctcctcatcctctcattgaggatcccatcagttttgggatctgcctttgaaatcacacatttgggtaccattctgtaagaatcaatttaattttcagggggaaaaaagtgttctggagctggaagtttagaacgcaagtaagtcgttaatacgacttactctattttgtttgtagtgagaaagttaaatggtgcttatagaattaccttgcctctattggcagagagtaaaaataaactgagctctcaatatacaaagacttccccagttcttttcctttcgctcatatcaatgcctgtctttaaagaaaaaaagagggttatttttctctcctccatcagtgggattctctgtattttaaatatcttttttaagactaatgtcaggtgactcaaattccactgaagtctctctttttagttgtctttctgccgctgcagacttctcttgacatgagactctgtgctgcttctcttgacagactgcatctcgatggcagaacactggtaagaagctaatgatgttggttccgtttcagtgtgtggaatcttgttatgtggtatagaagtccagcattctaggcgaataaaccgaaaggtattagactgactataaaggggtcttgggaagggatcttactcctctttgatagttggtacttgtaccttttctcaacacctgcgacattttctttttccagagatagcatcacatgtcaaggtggaacatcagatgcttggatcaaccaatgagttgtatccagacctgtgaccaaaactgaggtggcatttgggatatcattcaccttttggtctgtgcttcaggccatgagtagttagtgtatagcacatgttcacaggcattagcatctcagtcttttgaaatatggctaaaatttagtattccacctgcacttgatctacttgagaagtatttaacaggtctattttataaaatcccaaggcagccttttctgctacctgcttggattgggctgcatgaatataaactcattttgctatcagcctgagaaataggcaggtatactggaaacaccttcttatctggggcaattggactagtaattggtcagttaattccaaaagtcagttaaaacagagagtctttaaaaacgaagacaaaactgttctcaagcattttatttattttaatttttttttgagacagggtctctctattattgccccagctggtctctaactcctgggctcaagccatcctacagtctcagcctcctgagtagctgggattacaggcacatgtcatcatctagctagcattttattttaacttaaaaatatgtaaatgccagcctggccaacatggtgaaaccccgtctctactaaaaaaaaaaaaatacaaaaattagctaggtgggtggcaggtgcccgtaatcccagctactcgggaggctgaggcacgagaatctcttgaacccgggaggcgaaggttgcagtgagccgagatcacaccactacactccagtctgggcgacagagtgagaccctgtctcagaggggggaaaaaaaagtgaatgtacacatattcacaaatctttttatgtgggccagggctttttcttaaagtgtggatctttcaagtagagttcagttgactttctttcataaattatacacttaacatttgatctgtgatttccagtttaagtgaaccaagttcttaaatacatttgagaaatgaagggcagaattcttccagatttttaagctccaccactacaaccttttactgttgtcttgcccatatctaattcagcagcaattttttttagcaacttgccttcaaatttcttccaagcattcaacctctttttcatagaaatatcttttttatactcatatttcacttgtttgtattatataataatttaatatgtaattaaaataacaagtatacctagcgtgaactaactactgaccctgaagcagccaacctggctggtgggagtagatgtgagtaatacacaaccagcctccagtgtgctatgcaactcagccagtttattttgaagagaagttggtatgtcacataagctggcaagtcagttaagaaagtatcacccgtatgtttctctcctttttgcctctactgattgctatgggacttttatcttagcacctgttatcataattcctctattaaactataagcttttggatggcagggcccttttcttacttatgtgtgtatctccagtgtctcctgatatagtgtctggcctatagtaggtgctcagaagtactaactagacatatatatgtcttagttcagtgctatatatttgttggtgccaaacagctctttattgaatagatggatatatgtatgtattactgcacataatgtactcaaaatccaaatgagaacctatagagtatctattttttaggatttttgccatactggttccttgtgtttgcatgaaaaactgaaaattgactgtggagcttttaggcttgggttggaacaatatgtattttagaaagattactctcttaataataactacaactcattcttagaataataaaaatcatatcagtactaagtaatatttatcaactgcttactgtgtgccaggcagtatgctaagtgtgtatgttatcttagttcatatctacagccctgaaagaagacacaacaaggcatgttgtgttattatttccatttatagatgaggtctctttgggagccagcaaggaggtggtacaaggtctaatctttgaacagttgagaaatgggtagtttgttttcatagtgctgcttcttattttcaaggttgagggcccttctaggcgaggtgaaaggaacccttaaatctagagactgcctagagggagaaactgacacttacttttggctttctgggaaccagggtaggtcctctcttaattgaagagaattaataggatcctgtggctgggcattgggcagagtgtttgaatagctgctggccatggtaggtaatgccaaagtggcagtgaaaacaagctactgtgggacattagaccctgcctgtcacttttcttcccaggccactcacttgttggagggcccttctgaaactcctcttgctctgtagtctggatgcttgtgaacaagctgcttgcaggtgccgaaacaaacagcagtgtgggtctcagggcctgggcttggaagctgggcagagggtggaagggctccatttgggagcagtgttgatggaagtgatttttctagctgaggtgcgaggttggttctgagctgaatttaagagaaggctatggtcttttgtccttccacacttttgggacccagcagatactacaaatgcaatctttacaaacccactcactgccagaaatgaatctaaaaaagtgctagtctgtgggcctcttggtcaggaaggtgacagcagtggcaacagcagaaaaaccaatcaaacaaacaaaatgcctgtgggctggcaaacagaatttctttgcaaggttaattctgaatgtcagactctttccttttttgtaggttggaaggaggcagcagcaaagggaaagagatagcagttggaggccaccttctttagtcccccttccccaaagaagagccgtagctagtattgtggttggcattaaattgatataaagacaccctggcctggaagttaaaagttttttttctttcttttttgagacagagtcttcctctatcgcccaggctgaaatgcagtggcatgatcttggctcactgcaacctccacctcctgggttcaagcagttcttgtgcctcagcctcccgagtagctgggactacaggcatgcgccaccatgcccggctgatttttatatttttagtagagacggagtttcaccatgttggccaggctggtcttcaactcccaaccttaggtgatctgactgcctcagcctcccgaagtgctgggaattacaggcataagccattgctctcagccgaatgaaaagatttttgatgtactttttagccagagggagtttatgctgctgtgtggccagtttttccacatgtctgcaacagttacaatttttgacagatatcttgagaagattatagattttgatagaggcagtaactttattagcaagactgatttcatattagaatgaaatctctgggtctttttcggattactttatgttccttaaaaagaaagacattgggccaggcacggtggctcacgcctgtaatcccagcactttgggaggccaaggcgggcggatcacgagatcaggagttcgagaccagcctgactaacatggtgaaacctcgtctctactaaaaatacaaaaaaattagctgggcatggtggtgggcgcctgtaatcccagctactcaggaggctgaggcaggagagctgcttgaacccgggaggcagaggttgcaatgagctgagatcgcaccattgcactctagcctgggcaacagagtgagacaacgtctcaaaaaaaaaaaaaaaaaaaaaaaagacattgactggtcttggcagtctttgggttttattctgaactgtgtagagttggccaactcaggaattctagactagggagagaattttgcagtgcttttgagcatgtctgtgtaaatgtgctgtactcatcactatggaatggttctccagtttggctgtaaactcatggagctggctccttgaaatgctagcgtcctagccatgcacgcatgcaagcaagcagaatttgttcacgcctaggccatatgtggatgtcactcttcttcagtttcatatccagtttctgcttgcctgagctagaaatgaagtcatccagcactcacaaagcctctggccttagaggcttaaaaacaaaaacaaaacaaacatagcaactatcccataccaccttagtgaggtggatattattgtcctcttttcagaagtgaggaaactaaggctcagaaattaagatacgtgctcatggtcacacaggtcctaggaactgggatccaggatcccaaagtctgcctctaaagcctatgcgtttcccatagggctgctgaacctgacctttgcactttgccatttatgttacttcttccattccttgggagtaaattgaaatgggtttgggttggcgctgtggctcacacctgtaatcccaccactttgggaggctgaggtgggtggattgcttgaacccaggagttcgagagcagcctgggcaacataaggagaccccatctctacagataatttaaaaattagctggacttggtggcgcccacctgtggtcccagctacttgggaggctgaggcaggaggatcacctaagcccggaaggtcgaggctacggtgagctgtaatcatgcctctacactctggcctgggtgaaagagcaagaccctgtctcaaaaacaagctaacaaaaacccccctaaaaacaaaagaaatgggtttgagagagaagaagagagagaaacttaactgtgggtgttcgtagttaggtactcgtggaggaccacctaccatcagacgggagtggctagcccttgttttcatttatgcagacagacttccttttctacctctgctggttataccaggtacaaatagggatgctgcagtagagcagaggagctaaacgtggcttcctctgacttacataataaaataagaatctccccaatggccctttcctgtctgctggtctctgtgatgaagtgggccaccctagggacagcttcacttaagggcctccccagggttatcaggtccacaaagggtcttgggatcaaatgtacagctaaattgatgagatcaattcattaagataaagacttctacttccgaagcagtatggtgcttgggtcagtgtctcttgagaaattaatgtatagataaaatatttcatattagggagagctctgtgctgccctttcccaaagctttggttatttgatgggaggggaagtcttctcgaacctatgtcagaatattccgctttgaaagatgagggtttttcttgaggctagttttgtacctgctgtttcttttagaaatgattgctttatggatttaaaaggtgacccaaatgacttttttattattattattttttaatgctgggaggagtttgcgtgtgtgtgtgtgtgtgtgtgtgtgtgtgtgtgtgtgtgttttatctccttcaactctgaccacctggaagtcagcctaatctctgccctcgtgttgatctttaattcaacatttaattacctatcttggtatccatatgaatttgattgtttttttggctttttttgaactcataaaaggtatccaagttcctggagggcatagtgcccatctcctcccatccaccagtggacattcttttccaaaagacacatggcaagtacccctcacacctgagctgtggtggtttgggtttgtcccctttgcttttgtttgcagaacaccttttactccttttgcacttgatggttctgttgtacttgtaaggaaaatcagttgaaataaaaagatattaaattgagagacaaaaagatgttgccacactcccagttagaggcagactttagtctatattttcagatttattttgattataaagtgtagtctccccccgccaccccctgtctgcttttctttgtagttctgtaatcaggagtctgttattctctttccaatgctataattaatagtctggtctaaaatataaaaacctcaaagttattaatggaaatgtcactactcacctcatttttacagaggccgcttggcctctaagtcattgagtctttggacaaacatcatttagcattgactatgtgcaagaactgtgctgtatgctggggatttaaagacaaagaaatacagtttctgcctctgagcgtgcatcatctcactggtgaggctcacatacaaacaaacaggcagaattcagtgtaattgagaaatgttgtaattgagttatatatagggttcttattttgcacgtctctgtagagtagtagtttccatactgtgcggtatttgcctgttcacttgcctgttcctttgtgagctctcgagggccaggaacaaatatggatataaacatggaaccatgagcgaatagatgtttcttatcaatgctcggcctgtcttacgaggtgttccatagtggaaccacctgggaaacaattgattttgcattcttgtttgttagctaaatgcctgatttgctttttaggattcttttaggttaaatcatatgaaattaccattttgttgataatttcacatggttccatgtaataaaaagagatcaattttacagacttctggtttcaggtcatgcacagaggtgaagttctgcacaggtactgggcatcctatatgtatttccactaggttactatttccgagtgtgagtctctatttggaacttcagagagggagcctgtggcccagctactcctgtgtcactcagctctggagtggaattcttctaggtagtgcctgtttgtagactggacagggaataaaaccactactctgtgcccgtttataaatatttgcatttaccttggagaatgtacaagacctgggcttcatgcgtgtgtgagagaaaatagcaagtgaaaaggatgtgtacacagcagcatgaatggggtgctattcttagctgggtctctaacctagagaacaggaaacaagatgcttctgaatgtggactatggctgccctatgctagagccaagaggcttcgagtcatagggaaactcatgacagttgctagtgtccttcagaccttcctcttttgtagaaagtttcattctttgtgtgtctcagactgagatggaggaggggtgactctgttttctaagggatctagagagaaagggcagatgtagtcttgagcagtgggcttctcagctgtgctgcttcttccacggagaccatctggatctactcggttgatggagcagctcctctcattctgagtgggtttagcatttgagaaatagaggggcaccttggctgactggactaaaccttctttggcaatttataataaatgctctctgatttattgtttattctttcacattgaggttgaacctgatttgcctttgaaagttaagagcaggactaggactagaactagaaatgcctgatgtatactgtagcacacagtggagcgttgtccactttttagtcacttggtgactaccgattaattgatttgaatatatcaatgtctggcagttggaccaattactcagcttcccaatctgatggtgtggttgatagaaatgtttcctggtggcattttcccacaggattaggatggtggtggcattagccaggatctcttttgtcactgccactgttactgaatgatctgtattttgaactttcttgacttagtatagtattatacatccagcccttaccctaaatgcttattatttaatattgacaacttacaggttaatgttttaaatcttttttttttttttaaggcagagtcatgctccgtcacccaggctggagtgtgatctcagctcactgcaacctctgcctcccaggttcaagtgattctcctgcctcagcctcccgagtagctgggattacaggcgcccgccaccacgcccagctaatttttgtatttttagtagagacggggtttcaccaggttggccaggctggtctcaaacttctgacctcaggtgatccaactgcctcggcctcccaaagtgctgggattacaggtgtgagccaccacgcccggcaaaacagcatatctttaattagaacccaacacgagatggtatttcttcaaagagggcctgaaattgtggtattacctccaagcgaactttatgaaagggatcgggtctgtatataaaccatttaatttctccatttctctaaatgggaaaaaaaatttgtttttgtttcttttttactcagaacaccaagcccattcagccacctcaaaagaggttatagccagggcgcccctcttagaagaaaagacattttttttttttccttaagattggtgcatggaagcttagagcctcatttcaccacctctcctgatttgatatagatttatgagaaatgaatatagggaaaataccggctgtagacttgacaactgttaacttggtgaacagcatgttcttgtttatgttaactgtgtactttgactgttcaagatccccattacttttcacttgtcatgccacatcattgctgcaagttagcctccttagataagatacatggcagttagctatcttcacctgatggggaggaatagggtagagaaaagaatgtgaccagctgttgtcagcttctccgtggaagtggtaaccatgtcagagccaggccctggagacctggcttggaaaagaatgaagttttcctactaggaacttctgtagagccctagacctttccatcttagtgccgagttaaatgagtcacgtagccttcaggtaaagtcatttccaagggattgtgagaatgtgcccaggttggtttggactgtgtcacacttacttgtactggcttatctttgctactaatttttttgtgtgtgttattgttcttctaactattgttgatgatttgagtgatgcgaaagattttgatgatggtaactttctataagagatgtagaagcaagaggcccagagaattgatcttgcccttcatctgacacattgtgaccagtttgttgaacatgataaggcctggaattgtcacttcgaatgtcttcttaatctgggaaatttgaagaggtctgcagcagggaggctggtcagggaagtaactttgcaaaataaaatcttcatactgatgcaatcccagagaacttgcctttgggtttgtgattgcaaagtgttgaatcagtctttggtgtggatacagaatatttgaagctagttgaagtgtaggggtgttgggacaggagaaatgatgagatgaagtcttatcagaggctgaaggtcaccggatattttcctagtaaaggttcctttgatgtggaatttatccgtttagcccacctaattggagttatctggtttctgtccctgaagattctgctgttggccctggactacttaattctgtttgctcaccaaatcggtgacataagttacaagttatgagatttaatgtttagagtatggttttggattataggttccttgcattcttaagttagcagaaggaaaccaagagaagcagcatggtacaaacaaaaccccaaacaagtgctaatgtcagagagacctgggttcaaatcctagctatgccacatataagttttatcatgagagtaaattgcgtaatctcccagaacctcagtgttcttgttgctaaatgtgcacaaaataactggctatcttatagagacgttgtgaagttagagtgagtgaaggtgacatgcctagtaaggacctggcacgtagaagcacacaatcagctttaactgtttctgttattagcagtggacttagcactgtataaatctgtccctccatgcttcccacttgcccatttgtcaaatggacttgacattccttactcagtggttgacagggagccaagtgagatatctgagctgttgaggatggatgtgtatctcaagatcctggcattcagactggggctctacaagtcgcactatatttgcaagttgtagcagaactatattaaaaacatgccctgcctgtttcccctcgttggtcctcccattcagagaggggctttctggccttgtgctttaaatagtcctcagacggtaatgtggatagtagatgaacacaattcttgtgaatccatttgccttgtgcttgggagttctattcttagaccacaatcaccggaatagaaagcctccgaccccacatccgaactgaagccatgtgggcctggctaatggatttctttgggaagctgggacaaaggaccgggtctgcttctgtcattgactaggccaggtatggagcagtccattagaaaccagtctcctcccaattgtctggagtttatgagcctggcttacctgggatcattttcatgttatgatcctaattaaagttcagcctgtttactctgctccagtcaaggagttacagggggaatcaaggcagataagatgtttatgggtgaaccctgtttcattttcctcggatccacaattaaagaattaacagcacttgttatttattgagcagaaccgtgggcgggaggagggctttagtgcttgttttgctgcttctgtgagcccagggctgcgccagcagcatttcacttttaatccttagtattgttaggcctatacttccacctatagaggtggcaattgaggatcttgacttgcccaggggttcatgatcacgaaccttctactacttcataccttgaacaccatctcttctaatagatgggcaacaatatggtcatttctgtgaagatactggtgacttaaaagcattactaaatgtttattaaacacttgaatatagtaattatatatgtgagaatggattcacatctagggctcctgacagtatctgtcaagatgctggccccaaaccctgagtttgtcatgttatgtgggcatatttggttgcccaactctgaagccaaatgatgccagggagagagagcctccatgctgtgggggtgtttctaagagcagcctggtccttaattatcctactaaagacagtgtcctctgtgatctcagactcataacatccctgttaagataggagggggctgaaatcatttgttctccttcacattgaggggagactcaggcacagatgagagacagaggcagagaagttaaataattagtccaaggtcacatcaaatgatttccaactcagctgatgaatctgtctaggtctcggtctccaaatattgcagcttcccttacaatgtaatttgatctcaaacactttacgtgtcttatttttcttcctcctttttctattttggtaaataagatgttttttacacctactgccagattaatgttgggttttaatttagcccttcaagatgatcaatgacttaaccgaggaaactgctgccagaatgtagtttataatgtaccttttttcctatactcggttttctgcttctgtattttgtacattgtcagtctctgtgggttaagaactttgggactctcaagggtcatcttgacagaggagcttctgcagttgggaattgttacctttctcagagcagtgctattgggaaaaaaaaatctaagcatttttgttctcagcttcacagaggaagtgaagcacattcaagggtagcccattggcttctcgtataggaatagtatagatttggcttattttattccttgcttattataatattattattcataagcataccttttcagttaccctcatgatttactatctgtaagagcataagcttactgtttgtgtaatatttgtccctgtattttagatgggagttgctgaggtggtataaggtttggtaactgcatccggcctctcagggaaataaccaagttgttcagattcttagctgtattatgtgaagttgtttgtcagcttcattgcttactactgtgaaataagttataaagaggaacttttaataaaaataaatggattcactcaggggaggggtattcattgttggtgaaatatgtcgaggaccagatgctttttggtctcccaaagacctatcaaactgcagatcttttggctttgtaatatattcagttccacatttattcattcaagatttttgtgtcctcattatgtgccaagtactgggttggacactaggtgacagagatgaacaaatccctaatcttgggatttcacagtggatgttggaatttagtaccgtttagcttcattaggttctgcagtagtcccaagattttccaagatcatcctgtcctccagtgttctattgattcaacttcagaatatatcccagactctgtccctctttactcctcactgctgttgccctgggtccatctgccatcatctctcacctggattatctcagtagtttcccaactggtttccttgtttccattcttgcctccttctgtctactctcaatataacagctagaacaatccttttacaatggaattcagatcatgtttacccctctgttcaaattctccagtgactttccagtttttacatgatctggctcctactacctgtctcactgtgtttcctactactctcctgccctttctcctcttaataaacactgggctcatggtgtttcctttaacatgccaggcatgcttgaccctgtcctgtctcagggccctgctgttccctctgcctggaacattcttcccatagtgtctgcatggctcgctctctcactgctttggattgctgctcaaaagtcaccttatcaaaggcctttcccaaaggtttaaaaatcattctactataaagacacatgcatacatatgtttattgcagcactattcacaataacaaagacttggaaccaacccaaatgcccatcaatgatagactggataaagaaaatatggcacgtaagcaccatggaatactatgcagccataaaaaagaatgagttcatgtcctttgcagggacatggatgaagctggaaaccattattctcagcaaactaacacaggaacagaaaaccaaacaccgcatgttctcactcataagtgggagttgaacaatgagaacatacgggcacagtggggggaacatcacacaccagggcctgtcggggggtgagaggcaagggaagtgatagcattaagagaaatacctaatgtagattatgggttgatgggggcagcaaaccaccatggcacatgtgtacctatgtaacaaacctgcacattctgcacatatatcccagaacttaaagtataattaaagaaaaagaaaaagaaaaaaaaagtcaccttatcaagaccctctaggctactctgcataaaatataccccacttcatatttcctatttgatgtctgactccccctcctccttcactaaaacgtaagctccataagggaagggattttgtctgttttgttctgttgtatccctaaatacctagaaggtgctcagtaaatatttgttggttgaatgaataaatcagcctattatttaatcagtcaatgtcctctgtaaaaaggacttctcataccagtggcacatatctgtatgatggtcagtgtagggagggacatggtcagaatggctctgtctgtgtgggatagtttttcttagtataatcccagaagactcctattggggttaagccacagatttagcgttattagtaccactctttaatcataaagtcagaggatgttatgactggaagggatctgggggactgtttggtccacttttctcattattgatgtgagaataacagagcctagagaaagtaagtgaattactcacagtcataaagctgtaggggtcaatctgaaattaggcttctgacatacgattctgtagtctttcctgcatgtgttccccctggctgagacagtttgtgggctttcagagttgacaattttctctccagtctctaaacaggagcttttatctggacattctaggttagcatagatggacgatgaccctgtaatgtgtggaaagtcccaaagggtgagcactgtgaatgggaactaccccagatgtgtcaggagcaccacaggcacgctcactcttccattggcaggagatgtgtagggtggaaaggaaaccaaaatcaagaccctttgttgctccagttcttttattacatgtcacagtcgaatgtgtctccatttaaattcagattttttgatgaatggccagaccagctgcaggccctttgggccagaagccttgatctcgccaactgttcattttcttgatggacttccttatttcaggcatttgtgtgtagctggtctattgtggagttgtcagaggggtgtagagccccctctttgggacagtcagtcctccctgtgcagcatgtcctgaagctggcctgcctccatcctctttctaagtgtgtgaggtcttttgttaaacagggtaaagtgagggaggactcctaaagagagaaaaactcctccagcatttgctggaacatgtttgtgaactgagcaagatgtaattgggatggcataaaaaaaagacttacatttacttaatttcttgctgtctggtttgtgatatatggtgccccaaattgaggttagaaggagctttgatcatatgtcaaggaggtgtcatatttaattctactccctgtggcctctcttacaataccagtcatgcataaagcccgtggttttgctgcatctagttttactgaagcaaaggctctgcactttcatagtttacactgacatatttctagtttgcatctgaagtgtactctgaggatgctgacttccagatagccatttttgggttaagggaagttcaagtctcctgagtatagtagctacaccacctggagagcttcattttggtttggtgacaaaatttattttagcttagttttcttacattaggtgggcaaaataagaaaggccagaaaagtttaggacagttttctgagacactcagcaaaactatgaggcctagaattgagaactgggtattaccctgtagatgatgtcttttcaagctgggctagtggagtttctgagcagcagctgcattctccttgtacatcttcaggttttgtaggattacctttagccctctaagtgatcagatccgcctcactgtcactcatgggagcccttgatctggacaacgtggaccttgagtagctgagttcaaacaactgaggtggcaagagggatctcccccttggttcttttttttttttttttttttttttttttttttgagacagagtcttgctctgttgcccagtctggggtgcagtggtgcgatcttggctcattgcagcctccgcctcctggattcaagtgtttctcctgcctcagcctcctaagtagctgggactacaggcacccacgaccatgcctggctaatttttttatttatagtagagatggggtttcgccatgtgggccaggctgttctcgaactcctgacctcaggttatccacacgcctcagtcttccaaagtgctgggattacagacatgagccaccgtgcccggcccttatatatattttttaattgaagaggtagagaagcaatctcaaggtcaggacaacttaccctgaggttctcacttgtcagggattgtgctggattctgacttaggttctgccatcaaacacagaatgccctgatccttagaggcagaggcagctctttagcctatagggtaaataaccgggaatggaattctcaccaattcttatcttctatgctaaaagttttactttaagatttaggcctgcttttttctttctctctgtctctctctctttttttttcccccagtaacagtttaaaattggtgccttagacgcaagcaaaaagatattagcacagctttagaaataagtgtgagtccgcatgtaattttttagtttctcctctcccttcgctttttgctttcttggtagtatgctaattgtattctttttctgcatcttttttccccattctttggcagatattattacttgtcttgaaagagtaggtgaagagctgtttttaggactctttgaaagggtacagtatggatgacagtcttggctaaatgtaatcagatccaggaagctggagtcagtgtgagctggaatcagttcaaattagcaaagcactggcgctcagtggcaggaatacaagtgaccacaaagtgttaaacacatctggaaagggattctgacatcatcctgagaatctttggggaatacatatagcctgtagacccattcctctttgaccctataaagattctttaaagagtaataccctgagtggttttctggccagcttgcctgctcatttatctttgaggagatggaaggagacaatatgcctcgtggagatccacaggccctagaggtgtatggattgtgcatttggaagtgctgaagctgagagactgggtctcttggtggaccccaagggatctgcttttcctctactcattgtccctacacaacttttcctggcagctggcattgctgtttagatgggttgttctttgctgtttaagttgtttggcagtggtgtgtcaggatgcgggttttctgaatactttcccagctggttacttgagtggtggttagggaggggctgttctggggctgctctggagctgttgaggtcgggtgtctgtctggatactcacagctggtctgtcgaggagaacgctgttctcattctgctgcctttggtggtgctgtgtgtggctctttagatgtgggtggagatgagttgggggagttaatgagatctttttttagctgcttttgataaagtagtctgtactacaggattcattgtgactttttcccttaacctgtgcatacttctttgctagcctttgtgaaagagagttcaggccctcttgccctcttgctctttcgctctctcttgcccttctgccttctgccatgggatgatgcagcaagaagaccctcaccagaggcaggttccttgaccttggacttcctagcctccagaactgtaagaaattcttttctcttttcttttcttattttctttcctccctccctcacttccttcactctctctctctttctttctcttttctttctttctttttttttttttttttgaggcggagtctcgctccgtcccccaggctggagtgcagtggctagatctcggctcgctgcaagctccgcctcccgggttcacgccattctccattctccattctccagcttcagctcccgagtagctgggactacaggcgcccgccaccaggcccggctaattttttttgtatttttagcagagacggggtttcaccgtgttaaccaggatggtatcgatccttttttttttgttttaaattatgcagtctgtggcattctgttataacagcatgaaatagacaaaggctccattttcaagagcaagcccttttgtagtttctgagctaattatgactgcaaaggaagttctataggtagcctcagatctaccacctagtaaatctgctactacccagacctagaatctaggattctagatcaagtgctgggcaacatgatacctctgcaacttggcacctccctatatccctccagttggtttggcccatcaggactaatattacccctcatatcctagtctctcttgtaggcagaagccttgcctaaaccctaagctgcttagctcacattctgtcttgtcttgctttttctgttttttttttttttttttttttttttttttttttttttaggagggggttcaaatataaaatatacggaaaagaaatataatgaacctccatgtactcaacacccggattaaacagttatctcaattttgccagacttgtttcatctacttcaatctccctaaacatttacatttgtacaggaaaaactggataaatacctaattctccaccctatctcccattttaagtcatttttcagaataatgagttagtgactagtaacctccactgtagtgaccaatagttttttttcctgaatatcgtaatgagctcatagattattgtttgcatttgagcccattgtagtcactattaattgttttagatgctcatattgtctcaggttaataagtatctcttcaagttgactcccatggccttttgacgtgatcctgttggacttggatggcttccttgctttctggcaaaaaaaaaaaaaaaaggtgttccaggatctatatcctgcaccatacatggagtcagccatttctctagggggtcttgattccttttagtagagaacacagtttgggctctaggactgaattacttttgtgaacctcctctcctgcgattacagcctgcacccctgcttatagccagtagaagctcttgttgggcatcaacagatcgaaaatcaccatgtagttctgcctcactcttacaaagattcatctcttgagaattttgtgctctacccccgttgtagtctttatggttttgaaacttttgcttcagtcaccctgaattttgccagccatagacatgccataccttggattgccaaactgccctcactggagccaatttctctggttagaatagttgtcccaactcatgcttaatactctagtaagcaaggttccacctgggctcaggttaacttttctcctttgggccctgtgttctaccagcattccatttatctgaaaccctccctcacctcatcaagatcttatctggtctttaatgatttactctgctgcttcctgggttctaaagaacccagttcaggagttcctctttcagttcgagatcttattggcctgtctcgtcaggttggtgtcagcccagctaggattaagcagaatggggttgggggttgtagtgcacttttgacacagcgtgtacctggctgactacttctctgtcttttttttcctattgcaattcatgagtctcagcatcttctgaatggtgtttagtaggtcatcatgttgagttcctgctctagggagtagcatactctggctctgtatcattggcaaagggatttaaggttagatgataggctgcagttttgttaaatggaacaatatgaagagatggcattataaagaggcttggcagcagggcccatttgaatggttggttcttgattcccatgttgatataggcagatccttgacaggaattttgaatggtcccaaatgtggtaaatcgctggtacatcaagtcatcctcaaagttgtctgtgtaactgtgttgaatgcagttttgtgaatctctggtgattgtctgtatagggcttcatcatttagttattttagttgagcctgtttaacttcttcaagaagataagatatgtgaaagagatgcagacagtagggaaaaagctaggagctttgctcccccatcctctacttgggttctggaactggactcataggtgagtagtgaggagctgggctcaagcgaattaatcccggatctagctgtgctatgtgttcgctccagtccttgtgtcaaagttcactttgagccactcagagtagcgtgtagagtggtcattcaggactgtgctaacttacacttcattgtatcaaatgggagatccagtaatttatagtctattatttctggagtctggagatgactctgtataagctttgctgaagcagattttattacattagaagagaacctacctggctgcatccaacaccagaagcttttagatgctaagtaaggtggtcatagtaaaggtaacagaatgactctggaacccattaccccacccaagaaggggagtaatgaattccgggttgccctcttttcatttccctttgattttgagtaataaattccctccttacttcccagctgaacaaattgggagtctgtattccctagaaagactgttcacatacccatcagactaaattaggtgaaatctctttggccttaatgaatgttgaaggattttaaagggctaatggaaattcttctagaagtaacaattcccattctattggtgaggcagttctaaagaaagtccctgaacctcttaggttattttgtacagcaaaagaaccagcattgggttttctttgctaatagatgacagggagaatgtagacacttggaatccatggagaatccctaagttgcattttagccttcatgttatgtctcctttcctaacctttttaccagagctgatcacaggaaacagcatgatagatttgcatgacctagctccctgccttctcctgccattcttttagaaagtggtgagtggctgcctgccaggtaaaatctgggtgacaaaatccaaagttagattcagagttataagcatagcccccacccaagttgcttccaaagaaaagaaaggaagagtgttgtgtaaaatcttgcttctttgcctttaaattgggtacttattgagttaccacattagaatcgtgcattgtgctagttgttgtactcctgttgattgattaatttcattctacattcatggaacaccaacaatgtgcctggtactatgctgagtacctgagataaaaagataaacaggagttggtccttaccacttagagctcacagtctactactgtgagagtgtgggaaggtgtgataagagctatagtggtcttgccacataatttgcatttgtatcttaaagccagtggggaaccatggaaatattttaagcaggggagtgacatgattcatttgcattttactttttttttttcttttatgagacagagtcttgctctgtcgcccaggcttgagtgcagtagtgtgatcatagctcactgtaacctcagactcctgggctgaagtgatcctcttgcctcagcctgttaagtagcagggactacaattgtgcaccactacacactgctatttttttttttttttttttttttgagatggggtctcactcttgtttcccaggatggagtgcagtagtgtgatcatggcttgctgcagcctcacctacctgggttcaagcgatccttgtgcctcagcctcccaaggtgctgcgattacaggtgtgagccactatatttggtctcatttgtatttttgaaagatcactggtggcagtgaagataccagtgggttggagggagggagactagaggcaataacagtttagataatagatatttactgagcccctgctaagtgccaggcaccgatccaggtgctgggaacctagggggtgagtgaataagacagtctctgccctcatggagcttacattctaatagtggtagagtagtgtggtggtaggaaagcagactatatatatatatatatatatatatatatatactatatatatacatgcaacaaatgatattttttcagatggtgataagtaatttgaaaaaataaataaatagagctatgggagttagagtgtttgggcattgggatgggtactaatgggaatgggcagtgaaggcctctctgaggaggtgatatttgagctgaggcagctatgagaagacctaggcaagagtggtcctgatgggtggaacggcaagtgcagggacctaagatgtgaacaggcttggcacggtgcgtaagcaccgtaaagatggtcagagtagctggagcatggtggagcccagaggagcaagtaatagtcagttgagggtggagcacattctaagccatgggaaggaatctggattaattccagtggagtaagaagcactgtgattaattaaatcaggggtcagcaaactacagcccatgggtcaaatctgtcctgctgcctatttttatgaataagccatattggaacagtcatacccatgggtttgtatatcgtccatggctatttttaatgttacaagagcagagttgagtagtttcaacagagaacatatggcccagaagcctaaaatatttactatctggcctttataggaagagtttactatccctgaattaaatgatctaatttaagttttgaggagacactctggctactgttgagataattaatggtaggagacaagagtatatctgaatagttcagataagaaataactagatgttgagccaccagaaagcaaagatcacaccgtttttgttctgtttaaaaacacctaggtatgctttatactcattaaatattgttgaatgaatgatgagatgctgaataagggagtgccagtgaatatgaaggggaagtgaggttttgagaaatatttaggaggtaaaaaatcagtgcagcttattgttgacaaggtgaatagaaataggagtaggacagaaggaggactgtagatgcccttcaggcttctggttcagggatcttggtgcatggttggtgttccatgaacctagaatgaaattgatcaatcaacaggctattaactgagacaggagaagtggagatacaaagagcatacactgccaggaagaaggaattaatctttggacatgagactcccgggacatccaggtagagatgtctaaaaggtagttggaaagacagagctcggtggcatgatgcgtagacttatggtaaccagaattctggagtcgttagctagtgtgggctctcctaagaagggtgtgtgatgagaaggtcagggttggatttcataaggcattcatttccattacattttggatccagagaggaggcaaaggtaaactagctgtgtggacagtttgcatcagtcagtcagtcagatcatcccatgaccatggcatattttttctgcagaagctgataggctcagatgaagccttgccttatctgttcctctggctgccaacctctttctcttagttgggttgactggggcagtggtggaggtttcttcccagactctctgctaaggttggaacatttgtggccttttaattctgtaggtgattcatatttgcatttatctttttttttttttttaaaagagacagggtctcatcctgtcacccaggctggagtgtgatggcatgatcatagctcactgcagcctcgaccttctgggctcgagtgatcctcccacctcagcctcccaagtaactgggaccacaggtgcgtgccaccaagcccagctaattttttattttttgtagagacagggtctccctatgttccccaggctgatctcaaactcctgggctcaagtgttcctctcactttggctttccaaagtactgggattacaggagtgagccaacatgtttgcatttatctagttgaggctatgggtaggtagaagtgtctagttgttcttggtgttttgttagagcaagaactctctgacccaagggttaggtaagtggctaagttttattaaacattgttaaatattaataaatttattaaatattattaaatattattaaatttattaaatattgtgggttcttttaacccacaaagctagataaacccattagaagtcctgaacaatagcttcccctttcctttttgtctggggaaggggaaccacagaaatacttaataaaaaagcacttgtgctgaaaatggtcttaaaactggatgcaaatctcccctttacagaagttcattatgaaaacccaaggatgaaatcaacattgtaaagggagtagggaaggaggaccactctctatcccgctcttccacccccctcatatttttttcagcatactgtcacacctctgttgtttgtacatttttagaagacactttttgaacacattttaaccccgtcttacatataatattcaaatattagggtcccatgttttatgagtttctccttttctaaagaaacagttgagtaatagttttgctactcctctaacctaaattattcctgtcatgaggttagtgacttctgacaggcagaggtaagtagtttaaagcctgattacctagtcccaaagtggacgaaatggagccttgaaccaaataaataggtagtaaaggtaaatttaaaatatgaaaaaaaatttttttgaaaggcatatgttgacgagtattatttccactcctgtctggtccaccctgtagaacccctgctccttattgtgggtgtcactcttaatagttccttatatatctgtgcagtgtttctttatgtaagtaaaaggagatatgaatatatgttcttacccctccacgttcttttacatgaaaggtaaatcattatctaacctgttgtgtactattttgtccttaacagtatgtcttggggatctttccttgttggtacagagaaagctttctcattcgtatatcagagctgcatagtattccattgtgtggatggctgcctcctactttattgaatcagttccttacaaatgtgcacttgagttgtttccagtatttgctattacaagcaatacttcagtgaacaaaggcagctttttaaagggtcgcacagcactgcatatgctacttaaaatgagattattattcttcattcttagaatgccagttggttttgttggttgataaattcccaattactcgtattcatgagtgcaacattgatgatgaatgtgacatcccttcataacttaagaatcattagtatgactgccccatggaggcatactgttctatctcaggtttatttcaataataaaacctttggaaattttaataatgaaacctacttaagaccctttgcttaagaagtctgaatcactgatcactgcaattactgccatggcagctgtagagcaatttaacaggataatagtgaataagataaattacacttcagattcttaatggattgatgtgcagaagtatgcaagggaagatgggggtgggagaggagcgcctttaaaatttcagcacacagtaataaaatagggaactgggccattgtagccgttactactaggagttagtaatctcgtacaaacctctggggctctgtggtgggtagaatgtcctgtttattatagacaacaaattgggttaattctcttgtttgtgtgcctctgtggagtgggtggaaattctaggtgacttgctaattgtcttatttggaatactcccgtttctactaaagaattagtatctttggtataaaaataaggaggcagaccagttttacaaatagctgctggccaggagaataacagtttctgccaggtgagcagttaaaaaaaaggcagactggaaaaataactgtggaatggtgtttcttatttacaaggctaacataaagtctccctgtgtgttggggatgggggaggggacggattggctaagaagtaagtacggtgcttgctttgtatgtccctcgatttgtgtttaggggagaatagtgaggatgtggtcatacgggtaggcgtggggcccgaggaaggggtccaaggaagcaaatccaggagacttggctgcagttctacccttatggacattccttggcacttggtcacactgtggacacctcaatatctgctgggtattgatcttgtataccttcattctcagtacaaaacccttagcacccattatctcattcttccccaccaaagcccttggagatgaagagcaggagaatgaagtcttttctctcttaatgtttaatcagcattaacacacctttaagtgccattggatttagagcagtgttgttattaaagcaaactaaattgtcttgaagtgtagaaagcacttttagaaaaagaagcaaggttaggctgagagaacaagacagatgaagttactcctctgagctggaaaagatcttgtgtcaaaggaggaagcctcagagataatctgggccagaagattctgtgttcaaatcctggttctgcctcttggtcaagttatataacctccgatttataattatttaaatctgtaaagtaaagagagtgatatctaccatgcagtgtttttgtttttttttttttttgaaatgattaaatgagataatagaaataaagttggccctcaataggtggtagctgatactattaatattattaacagagggtcttctaaagaatctcatgatagttttggagcaaaggaaggcactctcttttacatgaggagattggtacttctggcagtaaatcgagggctgcctttagggttgggaagcatattgacagtattggaggaaggtgttagttgccatggcaacttgggaattcatttggagagagagttgtgactggaggttatctctgtaagagactgactggtggagattaaaaaaaaaaaaagcttgtctggcaggaatgaaatcttgcttgctgtatatctgcaggaaataccaagagatgtgctctagagaaagttccaaacatgagtcagaatgatgtgcaggccttctttggtaatgggtggttgtgtcttagtgggcctaaatgctgccaccagttgattgcttttgttcgcatgtattactttggtaaaaaaataaatgtatgaatgggatttcagtgaacagggttttatcgtgggtttttttttttttttttgtcttctgaaaacatgacgtcaaattgttggatattttcctacagttggtttagtccccaagaaggttttagtaaaagagcatgaatacagagcgtaactgaatcatttaccttgttcctaaggtaaatgacataaggaatacaagtatttccttttgattgggcaattaagactttttttttttcctataaaggttctcctgatagtgccacttgattactgattttgaaaagcctcttggtatgatgtacttaatgtccattgttagtttgtctgcttgtttagtacatctgctgttatctgttaccttctgattgcagccttgcctggaaacagggctggaccaaatgaaccccttaaaacagcaagattctggagtcgctgtttaattttttacaggcttccagtgcttactcacatctatttccttccttccctttcaagttaggggtaccatttgacttgcattggccagcaaaatgtggccatacatggcaattctgggcagaagcagttgccagtatgggacagttcagtgctctcttttcttgccttggtgatggtgaaagtttgtgagcaggtggaacctctgtcaatctgagctcttgaactacaatgatggaaagattgcccctccctgacccttgttggacacacagcataaaaaataaatgagcttttgtgaggttaagccactgaaattttgggggttagttgttcatgcagcagaacccagcccattcttactgccttaatagtcatttaatacatatgtattgagtatttaactttgtgctgggcactgttaggttggggatataacagtgaacaacacagaagtctcttctctaatggagattacatctatgagggagacataataaataaactaagataattaaatattgagataagtgctataaaagaaaataaacaagatcatgtgatagaaaaatctccaaagaacaaagaggctatgagaaggaaatgggaatcccccaggactcatattaatgacttttaatatttccctatatgtcttaagactctggatacttctagagtagtttcttatgccttggaaaggggataacactgaaggcaagaaagcaatgtgttgtattacttggtagcatgtgacaaaattaaataactagtgtactccaaaataaatgacaaccgagaatgatattagtttgctctgcatctttagaaactcattagtgtcctgctgggtttagtggaagatgaaatctgagctttgtttatgtgctgtgttaagcccctccccgagggcatccatcttcagcattcagactttccagagatctagttgcttagtaggtactgatccagtttaattgtattaaccagactctcacactggggagaagtggaatgcaaattgatgcataatgcttatatcttgcataatataattttggaaggaaatagaatgatgacatatttccttaaatcttaaatgctctccagtgaaaactttgagaatggttataacttttctggaagaaacatagggatagagctcaggtctgatcattgaggaacattaggttcagtgccagttggcaatgatgatttactttgtgtgaccgtaagaaatctcttggtacgagggtgggcagcacctattctgccttgataggaagaaatgagaaaagtgttacttgggagttgtaatggggaaaggagagctttatctgcttttcttttcttccttttctttggggcaaaccaaagcaatgagaataggagaaggtcaggagaggaggcatgtctaaatgacagttataaggaagaatcaattcattcaaaaactttgggcactggaagagtatgggctgtttaattctatgtccaaactgggaaacatgcttttgctactgcaatgaagggaattcagagtgatgtgcatggtgacatttgcccctcatccatcaagccagtcttatgatcatccctggaggaagattgagaatctctaaactggggctcagatttttctttctgtctcgaatattttagtcatctcatgttggcacatactctaaaaatctgatctgggtgaaactccagggaagtaggaaaaattgatcaaagtaagaacagcattgaagacacacacatccttgcaaatatatgggtttattgatacagtgtaaatttccgtgccaggacacatgccaacagtttaatgatgtgtatatagcaaagtcccttgttaaccccattcagaaactctaaaatgagttgcaaggctgaaagtattgaagccaaaggccaaaaacaatgatcatgttacctaggatctcatgaataattcagctgagtttaatgctttttccatggtgaaactaaaaagctgaaatatttggcataatgtagacaaattgtaccccgcttccttttgggaggatggttggtcatgaggaatgtaaggaagggtggagaaaaataaggaatcttttcatatttgttttaaccaaatatatggaatctctcaacattccacctctaaagaagtaaaaatataaaaattcaagttggggatttaaagatgttctctttgaatgttcattaatagctgaagatttgggcttgagaggcacttagaaaattgctcctaaagtcctagaaagacggtcacagaaataccaagagagaaggaatgcttgatattcttggtgataggaatcaccaagaatagtgtattggtctgtttcagaaaaataatagtaattagagatgaacaaaagagcatgtggatatttttgaaagttgtgtgcaaattgaattactgtaaatctaatcataatttcaaggcattagaaaagcattataacaaaacctgccagaagattagaattatttttcataaagtgaacgtgtttttttctctccagcttaatttttaaacctaggttttggtatattgatttaacttaaattgagacctctgccattcaggggataaagctctggacattctacatccttagacttcagttcttgcctcttaaataggtaaactctcctatttctttctacttttctcctaaaaataatgagaagataagcaagttaatagaatctaagaatgtttgagctggaaggtgcttagagatcatctagtgcaggtcactcatttgactgaaactaagacctaaagaggttatgtgactcttcagagtctccagttataaaagagaaggcaaattattatgaatagggcaaacataactcaaagaaggcattctttttattaaaaaatatgggaaaggaaacagacctggctggcatggcccattgttttcattctctatgtttctttttttttttctttgagatggagtcttgctcttgttgcccaggctggagtgcaatggtgcgatctcggctcactgcaccctccgcctcctggtttcaagcgattctcttgcctcagcctcttgagtagctaggattacaggcatgtgccaccacgcccggctaatgttgtatttttagtagagatggagtttctccatgttggtcaggctggtcttggactcctgacctcaggtgatcctcccgcctctgcctcccaaactgctgggattacaggcatgagccaccacgcccgaccttctgtattttttattgcttaaaatatgatgagatgcctggacattcagctgccatcttgtgatgtgaagtgctgtgttaactcactgaagaaaaatagatggagccctgcatccttaatgacaatcatcaagctgccttaccagctatgcttgtccctcctccaggtttcttcattggaggtcttcttctggatatcatggacaatataattccataaggaataatccaaaattgggacaaaattttggtaatctgtttgaagtcagtggagagctaacaaagcagcaggatattatggagccaagatcttggagaacaaggaaattcgagagtgacattgggacaaactttcccctagaggcatatcttctgattcttaaagaggcagctgagaggctagaaatctttccagcaaaacttactttttttttttttttttttttgagacggagtcttgctctgtcgcccaggctggagtgcagtggcgcaatcttggctcactgcaagctccgcctcccgggttcacgccattctcctgcctcagcctcccaagtagctgggactacaggcgcccaccaccactccgggctaattttttgtatttttagtagagacggggtttcaccgtgttagccaggatggtctcgatctcctgacctcgtgatccgcctgcctctgcctcccaaagtgctgggattacaggcgtgagccaccgagcccggccactttcaaacattcatggtgctagaggctcaaaatttaggacctgccaaggagagtgggccgtggcaaatatctttggctttgggttgctattctgaggtgctgaactttaggatcgagtatgaacggaaaattgactagccctcatagagactgaggcccagcttcataccctctcattccctgactgggttaaggatcttgattggatggccagttttcttagctccatctcagaagcaaaggacgatcctcttggtgaagtcttaaattatttctctaatttctatattttttcatataaaatgtccagtatgcagttaaaaacagccaggcatatgaggtaacataacaaaataatttgaaactaagagacgtaataaataatagaaacagatccacagagtatccagataatggagtcatcaggtatggatttaaaaataacttttcaaaatatgtttaagggtaagataaaaacaagatatattattttggcagagaactggaaattcaaaactggataaagtgacaaatataaaactaaaaatataataaatgaaagtaagaatttagtggatgggttttatgcagagtgaatagaaaagagtgatggatgaattctcaatagaaaaaaaggaatccagaaaaaaatggatttatatcttcaaaataaggaaaataacatacaaataaaattctctacagtgtgaaaatatcctttaaaatgaaggtgacaagttcttccatgcaaatatgatttgggaaaattttaacaaaagggcttatgatgaacatggactatatatatatatatatatatatatatatatatatatttttttttttttttttttaaattatactttaagttctagagtacatatgcacaatgtgcaggtttgttacatatgtatacatgtgccatgttggtgtgctgcacccattaactcttcatttacaataagtatatctcctaatactatccctcccacctccccccaccccatgacaggcccctgtgtgtgatgttccccatcctgtgtccaagtgttctcattgttcagttcccacctatgaatgagaacatgccgtgtttggttttttttttccttgcgatagtttgctcagaatgatggtttcatccatgtccctacaaaggacttgaactcatccttttttatggctgtatagtattcaaacatggaatatattttaagatagatataagactaaagcaaaggtaaggaaaggatggaagaataacgtgtgtaaatgatatatgttctgaaaaatagaaataaagccaataaaaatgggagcagaatggaggaaggcagataaaaaggggagaatagaatcagactgtcacaaagttaataaataattgggagtcaaagaattcattattgaaagctgacaaaccagatagtaggagagtaagaacaaaagggggctaaggacattataaaaagtattagtgtaaagataaccactagaacaaaaatgcggactcccctaaatagaaaaacaggcaaagaaaacaaatcacagagtgaatttaacataatagaaacagtaaaaataatataaaataatatgacaggcttaagactaaatatatcagtaatataaatatataaatgagctgaaaatcacctaataaaaggaaaatattttcagattgactttcaagcaaaaccaattcattgctctgtagaagagacatacctaaaacaaaaggattcagaaaggataaaactagtaggatgacttaaaggcatacaaagatgctcttagcagtgttaattataagacccaaataactaccaaaatgctcttcagaagtagaatgaataaacaaagtgtggtgtattcatacagtggaatactacgtatataatgagagtatgaatatgaattttacaaaacaacatggatgaatctcatagtaaggagtgaaagaggcatgaaacaagagtgcatcctatatgattccatttatatgaaattttaaaagaggcaggaccaatctatggtgatagtaatccgtatcatggtcacccttatggaagggtaatgactggaagggaagccaaaggggctttcagagcactagcgatgctctattttttatctgggtgctggttgcatgattttgttaactttgtgaaaattctttaagctggatacttaagagttgtgttcctttctgtatctacgttacattttaataaaaggtttacatttaaaaatataaactatttacaagcagaagatgaggcttggggtaaagtcccatggaatagctggacttagagtcatcagagagaatgatttttaattccaatttctatgaacactgcctctaggctctaaaggccattttcttttctttatgacacttcaaggttgctccctagatttgtttttgccatctccaaattaaaaatagagtctagaaaaacagggtagagaatgcagaagtacagccgaatacacaaaggcatttggcatagagtaaaccatggtatttcaaattggtgggatgggagagaggaatggatttttcaataactggttttgagacaactgggtagccatttgggaaaaaattaaattggatccctgtcttcctccttatatggaagtaaattttatattgattaaaatatacatgtacaaaatgaaaccataaaaatattaaaagaaaatatagaggtatatatttttaaaccatggaatataatgtaagcctgactgaaaattcaggagctatgtaagaaaagattgacaaattttaaaagttctacatggttaaaaataatatcataaaaccaaaagatgaactgggaaaaatatttgcaacacatgagaaggggctaatttcctttataaagtgttcacacagtcaacaaaaagtcaaaaaagatcagtaatccaaagaaaaaatgagtaaagaacatgaactgttgtttaaaacagactaactaaataacttactaacacccgcaaagacttattgcaacatggaaacctatgaacataggaaatgaatgatgccaggtcttattcataatagaggaatacaaattaaattgcaagtacagtatgtagtcatttttcacatattagataaaaaacatttgctcatacattgcattctgagtacagagtagcaagaagtctcctatattgttgaatgggcagtattagaaataatttaaaatgtatataccctttgacttactggtttccttctaccactttattctgtagatacacccacatctacattcattacagcattgtttatggcagcaaaaaattggaaacaatggcaggtaccaccaaaaaaagagactggttgaataaacaaaagcatagctatgcagtggaatgctatgcagctggtagaaagaaggggcagattgatatgtactaatatgaaaaatctccaagacacactgttaaatgaaaaaaatgtggcacacgtgccacgttttaaaaagggaaggggcatatacacagatgcttgtttacacagttagtatttcttgaaggatatataagaaaatggtttcctcagaggtatagacctttggggaagggtagggatgagagggaaacttacttgtcattgtttactgttttgtattgagaatgtttcccccaggtgaatgactgttatacctatttaggaaaacagacgaaaccaataaaaccaaactatttctatacagtgattattagcagagatgccattggcattttagatgcattttgggactgttccacacatttaggacattacattcctttccctttgcactaaatgccagtagcacttccctagacactgacaaacaaaaagtgcccctgtagatttctgaaaaggccagggtgtggattggggtggtggtgttgtttgagtctaaaagaatgtaacttctcttcagggtttcccagtttccaggttatgttggcctggcagggagggtcttgaccgacacggatggttatggacctttacttagtgaaaaactcaaatgaacttcctttctagaactcatggttttcattcagtgacactggactttgccctggagcagtgactggtcagggagctgtatctaagtgggagttgcacctgtgtgggcaaaagtgtggcactcagattttcgtaacaatgggcaagatttcaggaagcaggattttggttcccttactttaaaatgcatggagaatggctgggtttggtggcccatgcctgtaatcccagcactttgggaggccgaggtgggcagatcacctgaggccaggagttcaagaccagcctggccaacatggcaaaactccatctctactaaaaatacaaagcctagcatggtggaacatgcctgtagtcccagctacttgggagggtgcggcacgagaatcacttgagcccaggaggcaggggttgcagcaagccgagatcacaccactgcactccagcctgggcaacagaccgagactccatctcaaaaaaaaaaaaaaaaaaaaaaaaattaaaaaaagcatagaggactggttgtatcctaatagcactggtccatttttctgtggtgtgcattttagcttttttcctaacaaaaaaatcttaccacatgattctctgccaacagattttcctgagctggaaggaacagatgtttctgttggaaatgggcatctgtttctcccctcgctgtggcgtgtgcttcctatgagcccaggcccaggtaacagtgaattatcattagaaggctctctcgtaagactcatggggaagaacctataagaccctagtcttccaggaggccagaaggagagtagaatggagggtgagcttcagagcactgaggactgcaaaggggaacagagctgctgtcctgtctgcttggcagtgaccagcagctgcttctggccctcctgaaacaggaggcgagttactgagacagtagagaaaccctgagtctttagaactgtattatctacctgggccttataacctggacatgcccaggggtaaaatatatccaagtagaaatcttccttctcagaacatacccagaaataatgattctctattttgagtactttcttgtgcagtatactaaccaggtgcctactgctataaattaatttttttatttttcgtttttctcttttttgatggagtctcgctccgtcacccaggctggagtgcagtggcacgatctcggctctctgcagtctcaacctcctgggttcaagcgattctcctgcctcagcttcctgagtagctgggactgcaggcatgcgccaccatgcccagctaatttttgcatttttggtagaggtggggtttcaccatgtttgccaggctggtcttgaactcctgagctcagctcctccactcacctcagcctcccaaagagctgggattacaggcgtgagccactgtgcccagcaatttttttctttagtctaagtgtgcacattaatgcataggaaatccccatctttccccaaccccctagtttttcttttcctctttttaaaaactggattttcattcattctttccctttccgcctcccatcccctgccctccccaaggcgtgttgtaggtacccccagaccattgcgttaaagcgttcaggatagtgctctgctgattttaaaaaaacatttaaaataacatttcctgctttttctaattagaaaagcaacatgcttatcatagacagtttggaaaatacagaaaagcaaagtgaagaaaataattatcaaggaaaacgatatgcctttcttttaagccatcattttctctccatctttgcagccacaaagtcctttgttccactttttacgtcttagagtagctgggggttggcacacagatggttggaagtccttggatctcactgtgttataagagtacagaaatacagcaggcagctctttggctttgttttgaagccctgaagaatgggagaatgctctgcatcactggagaacatttgactgcattcatctcccaacaagagtggttgctgggaggaatgagcagaaggagtggtgtgtaccagactgtacaggagtctttcctccctaggcctggtcagcttttgcccttggacaggggaagaggatatctggggatttatattttctatcagaatttgagccttgtcaccttggctgtccctctgtgtccttgggtttttaaaatggaacctctttgttgtaaaatattagttgtacagttgaatttttcagagtagaattgggatccagagtgagaaactttctccctgaaggggctccctggacttttgctcttggcgagttgctggcagatactgacactagaaataagtgtcagagaggtctgatatcacttcagtttcagactgaccccagagcaacccttgaggacagcagtgtgtaagctcaaaaaagattgttctaattttgatgaccctcagagttaaggcttctaggggaactcttcattttcgtaaaaatccgtctgtgggtggtcactgtgttgagagatgagaatttatgggttgaagttgtttttatgatttcagactaagtgcttctacaacgggatattgggcttgggagtgtagacgttgtgggaccaggagctttgcagacttcccttgttcccaatttcttggattttttttttctatcccttcattcagttgattctgatgtcctagtattttttcctagatcccagatcaagagatacttttattcctaattctccctctgaaaattctatgtctttcagaacaagataggggaaaagagaaatgagcttattaaaaactatgatatcacaaggtcaggagttcaagaccagcctaactaacatggtgaaaccccgtctctactaaaaatacaaaaattatctgggtgtggtggcatgtgcctgtaatcccagctactcaggaggctgagacaggagaatcgcttgaacccgggaggcgtaggttgcagtgagccgagattgtatcactgcactccagcctgggtgacaaagcaagactcagtctcaaaaacaaaaacaaaaacaaactactatgggctggacatggtggctcatgcctgtaatcccagcactttgggaggccaaggcaggaggatcacttgagcctaggagttgaagaccaacctggacaatgtagtgagaccttatctctactaaaaataaaaaataaaaaattcaccgggtgtgatggtgtgttcctgtagtccctgctaatcccagaggctggagtgggatgattgccttaccccaggagttcaagcttgcagtgagctatgatcatgccgctgcactccagcctgggtgacgcagcaagaccctgtctaaaacaaacaaacaaaaaactagggtggttaaaaaaaaatcttggtgaacaacctctcttgtggattgtaatttctcaaagaaaaatatgatgtaaagattctttcttttactctcccttccgggtgtctcatcaaaaagcgtatattcctgagctttgctggcaatcgtattattttttctctccacctcagtccctgtaactttcctctttgtccattctggagttgtggaggtgataaatgggtccaaaaatgctgttaagagtgatctttaggtgggcacaggttctttatgatatatccctaatcaagagcctttacaggttctccccaaagtctctttgtgcaggaatgggagcctgctgtgttttagactggatggggctctgaccaagtattttttgtctttccccgcagggcatagtagtaggtgctcagtaaagatttgttggattgaagtggtttgaattaaatatgatttgtatgtaattttatattcaaataaagtctgttcctggtctgagttacttttcaaattatatattgttactctgaagattgtcatttcctgaattttattttctttgttccttttcacccacttgcttccattgttccaaatttagtcgtgttggaaatcagactaggtaggtgtggaaataattgtcaaatcaaattgttcagtcaggggaaggtggggggtagatggctaaagacatcagaatcttttgtctgggttttagggtcagaaaatggaaactggcagagcaaaaaggtcaaaaagtatcaggaataccctgctttgctttaaatctctatttgccttagagcagtcatctgtagtgtggtgaccacaggctttctaatgtctatgggtttaaccccctagagagcaattcctttggggtgaggagactggaggggatattcttcccttccaggggtcttctcattgccttctttttaattttttaaatttaaattttttttttttttttgagacagagtctcactctgtcaccaggctggagtgcagtggcgcgatctctgctcactgcaacctccgcctctcccgggttcaagtgattctcctgcctcagcctcccaagtagctgagactataggcacgcatcgccatgcccagctaatttttgtatttttagtagagacggggcttcaccacatttgccaggatggtctcgatctcttgacctcgtgatccaccagcctgggcctcccaaagtgctgggattacaagtgtgagccaccatgccaggccccattgccttctaatagcccttttctcttaccctttagctcttggcgcttgacttcctatgtccatccccaatatccctactccgtgaaagtgaggtgaaaatgccatcatctttctgcctgtcctgcttttaatcatcttccaaggcagcagcaagtgcaattctagtccctttcaaccccgtccatgtgggtgttagactgattgtttagcttctttatgaagatgcacattagccattcagaaacttaatctcataatgatttgtgtgtgttggtaaaaaagaaaagccatgatctctgactggtatactcagatgttccctttggtcactgatggcaggatttcagaagcgaaggaccatttaatttaattttgcagatggcaggaggtaagcaggaaagcttggtcacaatatgccccctcctgggagagtggcttcagtaaattcaggttgccgagagccttagatgtgagaaatttaaccctctgccttctttccacttcccctcccttatataaaacttggttgttgtttttgtgtgtggggttggggggtggggtagggggtggagttgaggaagggtgggaaggtggagtgaagaaaattgcctgggttgaaaagccagtgactgatgtgagattaccttgtagtgatgttgctttgggcatatggattatgaccagatacagattaacccgttcctctataattgttttatggcctcatccttctgaaattgcctccttgtggcctgaaatcctttctggggttttccttaggctgggaactctgcttgcagatgagaaataaacctacctctctccagggcatgagttccacagtgaaactgaggagtagatggatgaggaatcttcttttattttgtttttagggtggtgcccttcccacagggaagcaagctgcggattctgaatttgttaattgcacagcagctgagtatttgctgcctagtcctgttgaagttccaggattggatatccaagctgttggcttttaggatacatccccaaatggtcatctatcactcttttttttttttttttttgagacggagttttgctcctgttgcccaggctggagtgcaatggcgtgaccttggctcacggcaacctctgcctcctgggttcaagagattctcctgcgtcagcctcctgagtagctgggattacaggcatgtgccaccacacccggctaatttttgtatttttagtagagacgagatttctccatgttgttcaggccatctatcactctttacggccaatagtcacacccaaaattttggtgactttcacagtctggctattggataaatttggtttcggatcttgccaaaatgaggcaaaattgtttttcttcatgcttcagagccatgctgctctataaggaagtctatattaaataggtaaagacatatttcttaataaatcagtctagatgatggtattcagaagcttgacaaaattatcttcctaaaacttgtttgttcctgctttgctaaaggttaatagaaataactcatggataagtagtgaactttttaaagttgctgtttttgtcttaaatccctcctgtctttgctcttttcccttcctttgtggtggctgccaatcctaccttgcagataacttctccctcatgaaaacagaggaggatctgatattattaatttatcctggtagtttgaccattgtaatgctgtccgtgaacatttgcatttcagttgtttatctatgagtagaaggccctctggctgggagtggtggctcttgcctgtaatcccagcactttgggatgctgagacggacagatcacttgaggtcaggagttctagaccaacctggacaacttggtgaaaaatactaaaaatgcaaaaataaaaaaatttaaaaaattagccggcatggtggcgcacgcttgtaatcccagctacttgggaagctgaggcatgagaattgcttgaaccagggagtcagggtttgcagtgagccaagatcatgccactgcactccagcctgggtgacagagtgagactgtctcaaaaaaaaaaaagagaagaaaatagagtagaagaccctttttttcttttagccactaccaagtaggtgaagatatacttatatgttttacaattattcattcatttattcattcattcatctgtgcaacaggtatttttgatgatcatgtatcagacactactctagatgctttatttcagtcaatacaataaagatctctgtgagttaacatttcagttggggaagagggagacaaacaataaacatgatgaatatataaattgctagtatttagaaggtaataagtacagtaaggagcatcaagaatgctgggtagttgtgaggggagttgctttttaaaattttttcttctttcttcttctacctttttttttttttttttttttaaagagacaaggtctctctctctcttgcccaggttggagtgcagtggcaccatgatagctcattgcagcctccaactcctgggctcaagggatccttctgcctcagcctcctgaagtacttgggaccacagtcacataccactatgcctggctaattttttaatttttaatttttattttttagagacagggtctcattttgttgcccaggctggtctcaaactcctggcttcaagcaatcctcccacctcagcttcctaaagtactgggattacaggtgtgagctacctgtgcctggcccaggttgcattttaaaataaggggtagggagcttttagatgaggcctcatggaataggtcacatttgtgcaaaaatttaaaggaggtaagagtgtaagccacgtggatattgggggaagggcatttcaggcagaggaaacagccagtttaaaggccttaaggtggagccctaaggctcaagtgtgcttggtgtatttgaggaatggcaagaaggccactgtggctgaagcagagtgctctggtgggaatgaggcggaaaaggactaggagatgaggtcagagaggagagggtgagaggtttttaggaggaagggaggagatgcctgattacatcataccatgttaggctgttggcttttattctgtaaatatctatatctacatcaattatatctctcaggacttacaactttccatctttatcgtcttctgaactccataagatctttctaagaattgaggggaaagttgattataagggagaatatacaaaacctggcatcgaagccttactagagacctggaacctactctttttgggacttggtaaattgatgagattccatgcgcccccaccccccattctctggcatacagaacaggaatacttatatagcttactctcaacccaacctttcccttcgtctgcttcaagaatctcaaatacttacgatttttggcatatttgacattattttagttaatttctgaacatgttttcccactgttaaccctcttaccccagacagcattttgaaacacttttttcttttttttcttttttttggcagggtctctctgtcaccaggctggagtgcagtggtgtgatcatggcttactgcagccttgacctcctgggctcaggcaatcctcccacctcagcctcccaaatagctgggaccacagacatgcaccaccacacctggctattttttttttttttttttttttgtagagacaaggtctccttattttgcccaggctggtctcgaacccctggactcaagtgatgctcctgcctcagcttcccaaaagtgctgggattacaggcataagccaccgtgctcggccctgaaatgcttttctctaccacctaatactttccagttctggaaatgaactttctgacagcatctcattaaatgaaataatagaagtgaaagcactttgaaactcagaaagtccaggaagaaatcggctggttgtctccactctcttcattacccacctgcatgctagcggatgtacatagccagaggatcactttggaggcatttcatttcattggcgggcgagggggcagttcttttggcctagttgaatattaggcatatctggatctagtctagccccgacctccttacaagtctttgtgctacaaagtccagcgttggtgtggtttttcaaggaaggatatagaatggtttattttggatgagaatttcattttgtgtacctgattttgtattttttttttcctcttaagacaaggtttcactatgttgccccagctggtctccagctccaaggctcaagcaattctcccgtcagcctcctgaatagctgggattacaggaacgtaccattgcgcccagcccttgttttgtttttgaaagctgtcgtgttactgcttaaagtctccaaactgttattgagaacactgaccagagccctgtccatagaccagtgtttttccaagtgcagattgcaactcctttgcagagtaggttgtggagccattttagctgactactcaccagctttcttcaaaatgtaaatggaataggatagaaaaataatgaaaaattgtaaagtgaattggatgcaaaaagggtaaatattgttgtgtcagacttttttgggtgagtgtgcatgtgttcacatactggatcacattataacatgtattgctcattatgggttgtggtcagaaaaaattcagaaaacgctgtctcagactgtcccaaagttgtatttgcttattatggaactgatgaggatagaagatgagtggctcagaaggttgtatcttggtgagataaaagaagacatcaaatgacagttttagttagaaaaataatcccaattgagtttgttactcttctatgaaggtggaagattctgtgccagaacattatgctcttcaggtcaacaggaactaagcttgttgtttctctctgcacaaagaattgtgcaatttccagcgggaactcccctctggaggtggagagggaaggggaaggaagagtggagatagaggcaattaggaagaaatctttactgtgagccttagctgacccaggatctgcacatagttaactctgaggctttgttggaatccgccaaagattcattgttaaagacagggaaagcacaactcatttccatttattttagttcaacatttatgccagctctgcgctaggtgctgggatataacaatgaataagacatggtcttggacttaacggtgctcctaacctggcagggaagacagatgtaaattgctaattattgtacattgtactgagtgtcataatacagtgtaaaatgctccagtttatgaattagaggaactatgctttcagccttttattctgagaaatgtgccatttaataataaagaactgggatacgggttttttttttctaaaatttggggaagactactttgttgaaaaggaaaatgaaatttccaagggaatcaggttcatccagtcaagctattgtgttattttgtgtcttttcctctaaaagtattctaatgtcaaaaaattttttaaatcaagttgacataatacacacctgcccagggaacctggagacctgtaaaataatttaaaaccattttttttatcatatctttaaaaaatactggcaaacatagtaataagaatttgagactgggtgcggtggctcatgcctgtaatctcagcactttgggaggctgagttgggcagatcgcttgaggtcaggagtttgagaccagcctggccaacatagcgaaatcctgtctctactaaaatacttataatcctagctactccagaggctgaggcatgggaatcgcttgagcccaggaggtggaggttgcagccagctgagatcacaccactgcactctagcctgggtgacaaagcaagactctgtctcaaaaaacaaacaaacaaacaaaaaaaacttgaacccgggaggcggtgcttgcggtgagcagagatcgcaccactgcactccagcctgggcgacagagtgagactccgtctcaaaaaaaaaacaaaaaaaaaaaaacttgagtgcttttctttgttggaacctgtaacactttgcttttacattctcattgatttttaaaattactaataactttttgagacatgtaaaatcatgacaaattctacagaagttctatcaaagcaagtcatgtagtgtgttcagggtccagaacctgagttcaccagctccaggctgattcacttttgtcagctgcatccaacctaagcctggaaccagattgaatcaaatgctaagttttaatgtctttcatttggttcttttatttagttcagtgtttcttactgctagctgacttggctctgaattttgttcctgcctcaagcaaattctgaatatgcccatctatggatttgaacagtaggatgttttttcagaggtgtgaaatgatcaggcagcttgataactttagacatactgtacgttatgaagcattttcttgcttcttgttgtctttttctggtggattgagtcaatgcagttggtagaatcttttccacttatgttattgaggcatgtggttgaaaagtggcctttaaatggtgtgaggtgggtaggcaggggataaattcttaccacagtttctaggatgaggaaagtgaaactcagaggcccaaatcttctgactcacacagtgattctggggctgtctgtaatatctaaacgatgagactgatctacttgcaaggtcagggcatgtggtcattttcttgctagcctttggatcaccaggctgtcagcattttgagggggagtatttgcatcttgctttatttggaagattcagcttgagggagtcattattagaagattcttagaacacttgagccctctgaaaatgaaaagtctcacatttcccttctactttggctctctgttggaggggaacacttatgtcattaaaaacattgtactttgcttatctaattcccactctgtgttcacattaatagcttcccattgctcttaggaacaattccatacttcttcagactatttgcaatactcaccagagcttgacccctgcttctttcaacagtctcatctttttttcctcttctcatttaaattctatgcttcagttaccctgaatttcttcgattatttcggttccttgcatgcagcttcttttctgttgcctctgggcctttgaacatgctgttggctggagtacttttcctgccttcttcccataggtaattccaatcctttacgtctagctcctctgcgagcctcttgctgagccctagaccaatttctgtatactcctacagcatcgtctttttccccgataatgggctttttacattgcaattacttcttatggtagtctgtcttctctggtagactagattcctttggaaggcaggcccaagaagctggtttaaattactggagtctgactaaaaagacttttatattagactggtatttcccaacatttaaaaatttatgaacttgggcagggcatggtggctcacgcccataatcccagcactttgggaggctgaggcgggtagatcacttgagaccaggagttcaagaccaacctggccaacatggtgtaaccccatctctactaaaaatacaaaaattagccgggcatggtggcacaccattgtaattccagctactcgggaggctgaggctcactagaattgcttgaacccaggaggcagaggccgcagtgagccgagatcatgccactgtactccagcctgggcaaccaagtgagactctgtctcaaaaaaaaaaaaatgaacttctttcagagtaatataattttgtgaaccccctcaggaatttaaaaaataatgtcattacttttatagactattataaagcaaatttatgtaaaatattttcttttacatcaacattattaaattattatacagcttattttaatatacactttaaaatttaatagcgtccattttatataaagatgttttctcatttaataggtgatatacactaatttatttaaatgaattatgtaagcgtgtgatttgtttaaaatttataataaaatatagtgcttagtttgagaccaaatatacattaaaaatatagttggaaatttaattacttgctaacacattttttaaaaataagagaaacctgcattcttgacctaatgtttggaatttttgcatttcacactctagaatgactgcttcttacatgtaatttttaagttttgtttctacatggtagcggttaccacagagagtttcaactgcatatctacaagggagtaacaccttgtagctatggaatgcctttcctctaacagttacaaagccaatttggatatggttatctctatatcttatgtctttaatattggattttgaaatactaaagatttaatcaggtaaatgtaacctagtgatctggtgaaaatcatctagatgtgaattggatgccttggtactgttttttatgcttctagttgacaattgggttttatcaatgtcttagacttcttgttgttggtttttttgtttgttcgtttgttgttgttgttttttttgagatggagtctcactctgtcgcccaggctggatacaatggtgcaatctctgctcactgcaacctttgcgtcctgggttcaagtgattgtcatgcctcagactcccgagtagctggaattacaggtgcctacaccacacctggctaatttttgtattgttttgtagagatggggtttcgccatgttggccaggctggtctggaactcctgacttcaagtggtcctcccccttcggcctcccaaagtgctgggattataggcttgagccaccatgcccagccaacttcttgtttttaatccacagtccactatgactgtacattttatgatatatgacaaagaataagagcagtgaaaaactgtagaatgctcataccatcttggcctaagtggtggttgcaaaaccaccatggcctagataatgatgtttattagctcatcacccctaatcgttgtgcatactcacttgatatatctgaggctctaaactgcccaattataaagggataattgggaagacaataaggttgttgattttttaaaaaaggaaacgaaggagttgccatgattgcggttagcagtgtgaagaccctggaagacctgcttgaacttctggggtgttcacagtctattgcttggtcaggagccttagaaaacttagacatatgtgttaggagaccaggttttgaaacttgctcagggttgcataaacttctacattaagttccatgatgccagattagtagtccacatttgcatagtagacatgctgttgctgttccttttcttatcacgaaaagagcagaagatgcagattatacctgagacagaaagatacaggggagatactgagcttgttgcctacctttgggcgcctctcatgccttgtatttcacattgagcctcacttatcagtgacacagggaatggtccttttgctctccaccttccccatggctgcctggaggcaggggaggcagattgtgccacttgctgacattgtgttgctgtggattagttggagggacagggacaggaaactttcctggtggtgcatgtgtcactggggctcacacgggtacttttaaatcttcttctcactggcctctgtgattctgtgaacctggttattacatgttcaaaaagtgtcagcttatttgaaagggatattcttattttgtatttaaacattatgaaagatcatcacacttttttttggagacagagtgttgctctgtcacccaggctggagtgcagcggtgtgatctcggctcagtgcaatctttgccttgtgggctcaagcagttctcatggcttggcttcctgagtagctgggcttacaggtgcaccaccatgcctggctactttttgtatttctagtagagatggggttctgccatgttggccaggctggtcttgaactcctggcctcaagtgatctgcctgcctcagcctcccaaagtactgggattacaggtgtgagccaccacacctggcccatcacactttttgggtttcaggatgccaacagatcctggattctggcatctggattatggtagcaatattgaaaaaaatattatagtggggagtaaaatttaggaaaaccttgcaaatttttattcttactcaggagctttgtcttcatactccatggtcagccctgggcaattaaaacttttgttccagtaaaggtttcattctaaagaggtttcattaattatgaaaaattccccgtgggcattacattgtgaatccttttgtagctatcataaataatgaaggaaaaacacttgtcaaaatatagcagaggtgactagataatgcatctctcctttgatttttgatgggtttccttttttaatttttaaaggaataactcttgcttatttttttaaaaaagtaaatactcgttataaaaaattcaagcaaaactgaaaagtaaaaagaagccagcaataaattgttccaaatcccatcacccaaaaaacagctcttgattcattcattcaatgtgcctttattgagtgcttactctatgtgaggcactgtggcatcggggatcagcagggaacaaagtgaagtccctaccatcatggaacttacactctagtgggaggagaaaatgataaacacctaaatagatttacaagtggcatgaagaaaaattaaaatgaggtaagagcatagagagtgtcggggcactttcagatggagtggtcacaaaggctgctgtgagcagagagctcaatgaagtgagagagctaaccacgtgactgtggggaagtgtgcttctagcgaagggaagcatatgcaaaggccctgaggtgggtgtttgcttgccatgttctatgaccagagaggccagtgtagctgggggccagtgagtaagggtgaactgggccatgtaaggttttggaaagccgttagcttttctccactgggaagccattgaaagatgatgagcagggctgcagtgtggagagtagactgcagggaagcaagggaggaggcagcaagaccagttaggagctaccacagcaattcagaacaaaatgaggctgagttgcactgttcaaaaggtggaagggataggaagggttgaattctagactcattttgaaggtagagctgataggatttgctcatgaattggattgggaatttgtaagagaagagtcaataataactctgaagatttgtggcctggcaggtgaatggtggtaccgttactggggtagggaacgtgctggggtgtggtcaggatggggtgtcaagagttcaggttcaggcatgttaagttctaggtacctgttagatggctatgagggaatggtaagtcagttggaggctggagttgactgagagatctagactgtagatacagatttgggaatcaccagacatagaatggaatgggatctgataggaagcaaggagagatagaaaacagatcctatgactgaatcatgcatggggcatttcagcatttagatgttggaaaaggagagggcccaacaaaggagacagaatgtgtgtctgtagcatatcaagagagtgtggtgttctcaggccagtgatggtggtggtggagtctcaagagttggcaatatttagccatgtgcaggtcattaccacccaccacaagagtggtagaagcaagagcctggttacagtggccttaagagaaaaagggaagaaagaaggtggaggcagggagtacggacaccattttgagtcttaatgtaaagagaagccacgatgaaaaggtaggtgggttgggagaagggaagagatcaaggaaaatatgcgtttgtttgtttaataagatgggagaaaatacagtgtgtttgactgctgctggtaatgggccagtagagatggaaaatgatgatacggaaaataagagtgtataattttaggaggaaagggcttgagtaagcaagaaggggtgggttctggtttgcaggtagaaagataaacctaggttagaggctgagacagggcaggcaggtaggaggggaaggctctggatttggtaatggtgcgtatggactttctcttccagtgttaacatttggtacacataaacagaagggtggctggtgagggtgaaataattttataagaatggcattataccgtatgtactataaaaataaaaataactgcatttctttttacttgaatttaacagaagaaaagaaaactgaaatgaaagtgaaagagctgctgtacttttttctctaccaaagataatagttcctaaaagttttctctaaggttaaaaaaagattatgaaaactgttaggaggctaaagtcactattaatatttttaaagacatttttagttatatcttcactttagatgattgtctggaagaattaggtaattcgtgtttttaaacttccttgcactactcttcctatctctcaatttttatagcttatctttttttttgttgtttctttttttgccttggcaattttctaacatttacattccaacttgcatgctcccattttttggtcttggtgccatatgtagccacttgttctttgatcgtggctttcctgttcctgtggtttttgttttgattgatctactgggtgcaagatttctgtttctcaagacgagttcgtgggtgcttcataggctgagatctttcaagttgcagaggaagagagatgtctgaaccttttttacacttgagtgatgactcagcttctcctaatattcttggatcacagttgctctctatcagaattttttaagacatggctacattatcttcaggccttgaatattgctatggagaagtctgagaccaatctgggtttctgctgtattttgttagcaatccattgattcttaaataactctttctttatccttgaagggcaaaaatttaaacattataagtctttgttgatttttctgtgttcatttcatgatatattatgggccttttctattcacagatttagttctctggatatttttttctgttttatttattgtcttcctctgcatttattgtgagtctcttaagccttttttttacacaccattaattagatatttaaaaactttttattataaaaaatttcaaatatatacagtagagagactagtgttatggattctcatgtacccatcatgctactttgataatcatcagctcagggccaattttgtttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgccagttttgttttatctgtatccctcacccattcccactctcctccattactttgaaacaatagcagatataatttatctttgaatatttcaatatttaagagataaggaggtttttttttttttttttgagacggagtctcgctctgtcgcccaggctggagtgcagtggtgccatctcagctcactgcaagctccgcctcccaggttcacgccattctcctgcctcagcctcctgagtagctgggactacaggcgcccgccaccacgcccagctactttttttgtattttttttttagtagagacggggtttcactgtgttagccaggatggtctcgatctcctgacctcgtggtccgcctgccttggcctcccaaagtcctgggattataggcgtgagccaccgcgcccagctggactgttttttttttttggtgttttgttttgtttttttaaacttaaccactaataagtttcatctagtctgtttataatctttttactaaatatataacaacattgccttgtggtgtttagatcagcaacttctttgctccaaaggtacagtgaatgatgacggttgctgggcctcaaaataaggaagacgaaactaagagaacaggccacaggactctccctgatgttgaatggcagcaccttagattgggcaacagtaacatgagttgcatacataggaagtgcccactggttcctgggtgttctctgaatttctagtgctcacgtgaactgtggagggcaaaggaggaggatacggaatgtacagtttcttttacagcaagaagtgaaacttaggccctttctgatttaataataacccatgaagaaggagctgagtggtttgaagactgttctagttctgcctttggtggccatgtggtttattccacagcttttcaaactgcaggttgagaccttttactaaatcatgaaagcaaattagtgagccacaaccagcatttaaaaagttatagaaaatatcagagttcatgactaaggataaatgttgtttcatgacacttttcagttgtgtgtgtatgtgtgtgtgcatgtgtgttggattgccaaagtttgaagccactagttttgttcaattcctatcactttctgtaccttctttatcgaaaagttaaaggatcaaagaacctatgggatagattttatgtattatcagaaatgtatataagtcgggcacggtgggtcatgcctgtaatcccagcactttgggaggccaaggcaggtggatcaccagaggtcaggagtttgagaccagcctgaccaacatggtgaaactttgtctctatacaaaaaaattggcccggcgtggtggcaggtgcctgtaatcccagctacttggaaggctgaggcaagagaattgcttgaggctgggaggcagaggttgcagtgggctgagattgctctattgcactccagcctgggcaacagagcgagactccatctcaaaaaaaaaaaaaaaaaaaaaagaagaagaaatgtatgtagtgcttacagtataatgtaccaggaattattctaataactttacaaatattaactcataaaaactctgtgaggtagatactgttattaacaaaattttacagaatagggacattcttgcatagagagataagtaatttgcccaaggtcacacatagctagtaggtggtggagctggcattttgagcccaggcagtccagttccagggtcagaattttctctgcggcctctccagtggatagcatctctagatgatggcatggactttttcctgctattgccttcaagaagaaatggtaaaaaggtggttccccctctttcccaacacatacacctaaacattcagagttaagacagtgagaatgaggattcttaatttggtgaaggtgaaggaattcggggattctttttgttaaccaatcaacattgccagcctagcactaaaagattccactatgacagacaaccacatgaggccgtatctcagcattagaaacaaatggatgggggagagtggttaagagcactgattttaagaattaaacacatctaggttcaaatcctgttgtgatctgttactgtctgagtgagcttaggcagttaactgatctctctgaacctcagtggtccctcgttgtgaaatgggaggaatcgtggttgccttttaatggaggcttactaggcatcaggcatgtagcaagcactttatattctccatctcttttattcttcataacaatccagtggagtggctgctattacaaactccattttgtagataatgaaaacaacttagagagattaagtgtcttgttcagggagacacaggtaccaggtggcagaactacaattaaaattcaagtttttctgaatgcggtctatcctcttaatcactcagctttgctgtgaactaatctccctggggtgttttgaggattaagtgagatacctttatacttgaatagtgactcaataggagcctacttggcacataataagcacttaatgaatgggatatgtgattactagtaaatatataagatgtgtctgcctataacttttgtggggacagtttacctttccataaaaaaaaactgtggtcaactaaatcagttcttataacaaaccagtcacttcacatgtatattgagttgttgaaaaataaatggttatctattctgaaggatctgctgggcagattctttcattggaataagttttgtcaaggacgggactgtctacccaacatccagaacagtacctgtcacaaggtaggtgtcttagtctagagtccttgaaaatataaattagagggagaggcaaaagcgtacacttcatttgcaagagtcatcccagggaagcaggaatggggagaaagggaaggagggagaacataacaagagattgcttataagttgactatagcttcatgagaggatgattgcttggtcttgtgggacatcttcatgtaactatgtgaagctactgcatctctgaacagtccactggggcaaggagggaaaatatttcattcgtcagtttctatctcctgtaggtcaaagtttgattcttgaagcctccacttctctgtacttgttgttgacatgactgctgattgaataggtcactccaagtctcatgcttcagtagcaggagagaaagcctgggtgggattgagagtcacgccgcaggggtagaaggcaatgcactgtcaggctggtgcatcaacaacatatgaaggcccaggaacagccattgcaataggaactgggcagactgtttcagccagcagcaaggtagttgtgttcatctggggtggtgcataaactgaatctggcagagcaggccctcaataatgatagacttctcattgccaaggttaatgagctctttgccttgctgtcttatttaaatactccatagttattgacacttttgtacatctctcttcattcttaatctactttcctatctctccttgctttgctttccacctaaatggggatatcctaagcctacatctttttaattctacatgctgtctatggacagctgcattcactttgctggttaacttcctaactgccatctataatatttgctgatggctcccaagtgtctatttctagacttgacctctcctgagaacagaaggagaatacaactgccttttccagtaggatgcttcgtaggcatttcacgggccaactgaacttcttggtcttctttaatcatttttgtttgtccttctcactggtaacgaataggtgcttggtccctgcttgttgaactaaacttgaaacaatgtgccagtacttatgctaagctgggtcctgcacaaaatgaagtgaactctccagagccagctctacaggaacgtagggtctggattttaatattgatctggtttgttttcaactcgattgtgttggagccttgagcacatacagtgtgcctttgtcctctaagagagtggacatgtttgaactgacatttggtcttttcaggaattgtttggtaggaaatttcttggatttttactctccttgagctttgactcttcttgggctgtcctgcttttcaagactctcattttgctttgtccagagtttacagagccctttagaactgtgtttgtatctgttctgctcatcaggcatgcaggaccctctctgctggccctggcctgcttatttaccccttctcttcatactcttctgtgtgaaccttcaagtcacaaggcttctcacagcctcctgagcttcatctgcccattttagcctctttgactttgctttgctaactacaacccttcatctgtcatccccctcgcttctgtttaaatccccccctacccaaggtctcaagaggtccatgctagattttactgatttcttcctctcttaatgtagtctgggaccattattttggcacttaggatgccagtcttatactcttaaatatttttgcatttagtcctccttttctccaattcaattgtaagctccttgagagtaagagactgtcttacattttcttgtgtaaatatcttacattttcatgtgtgttccaatgattcatcacccagatcttcccacagagttggtgttagataaatatttgctgggtttgttggttgattatcgtggtccttgggaactgacttgcagcttgtcactagcaatgaatcaggagcatcagactagctgacatttcccagaggagctgctggtcttcacatcctgcatctttagtttgtggtacaagttaattctaaattttggaccttgagaattctgtttcttaaacatctcaggcaagacctaggagctaaaattactactttggcatttgatgtggcagctttttcatttgggatccttttgtctttaacttgcttttgagtcacttgaaagaactaaggcagcctgccagagtagtcacgatgatattgaaatatccctctcattggctttatgagattgccttctgtgcattcacttggggctggaaagttaatggatgactgaacgtcttttggaaacttgtagggccatttttcttcttctctttcccactagctggtttctctttgttaccaaaggtgcatgcattgtttttaggtagtgtggagttaatgtaaggggaggagtgtttctttctttcatagctttggaataatctaccgcacagggcagacagttttgaagatggccatgtttaaagtccatcagagaaaactacagtcaaaaggaaagccagggaggccagagttccagtcacaactgcccccactacccccttcctcccaccaagattactgtcttacctttgaacccaaggatgtctcttatggctccagtttgctgactactgtgaagggaaggatggtttggaatcatactatagagtcatgggctctaaagtacgtgttattgctaatgattggtgttggtatgtgcagggattttccactcatggaattctcctactcattttgacctctctaccattcagcttgtattgctcattaatgttcactccatttcttcatttagacagcataggactccatccagcagacttccttcactgtgatcttgcttcaactccatttattacattcatcatgacacaaacttttaccagctccatttctggctgcttgagatccaaactactctattggcctttggagctattcctcctcttgcacctttatctttgaccaagcctcagtgccaccttttgttccagtaaggacatcttcctccctaccccacagagaggccacgctcaaacattcctatctcttggtgtacgttttctcttactctgggatatcctctcctcacccttcatttactgaaatcctactcttcctcagaatactacttcagatttctgtttccttccctttctctctctctttctcctctcctgccttccctccacaaacttggaggcctactataatgctaggtgttgttctgggtcccacaagtacattagtcaactgaacagacaaatttattctttttttttatttttattttttgagatggagtctctccctgtcacccaggctggagtgcaatggtgtgatctcagctcactgtaacctctgcctcctgggttcaagcgattctcctgcctcaccctcccaagtagctagaattacaggtgtgtgccaccatgcctggctaattttttgtatctttagtagtgatggggttttaccatgttggccaggctagtctcaaactcctgacctcgtgatctgcctgcctcggcctcacaaagtgctgggattacaggtgtgagccactgtgctcgaccaaatttcttcttttcaagaagtttagactacctccagaagcctgactatagtaatgggattccccactgatcttcctgagctttcaacactttcattgtagtatttattcttaatttcatgtccttatagtatacaataacataatttctgtactatataattatatatcttgtgcaattatgtaatatgaattgttatgtgaaattttgaaatgtatatttggatcatgtcttcacaattagattgtaatttcttgagaacagggaacttcatacttcagaaatcctcagtttatccattacagcccctttgcaagggaccaaaaatccaaggcaaagtggtttttttgtttgtttcttttttatatatcttttattttatttattttatctttttgagatgaggtcttgctatgttgaccaggctggtctcagacttccggcttcaagcagtcctcccatctgggcctcccaaagtgctaggattacaggtgtgagccaccatgcctggcctaggcaaagtgttttaagcgaaaattgaatgaattgacttgtgtcactgaaaggtccagggatagggctggcttctcatcgtgacttcattcagatactcatgtttccttctccccatctctcagctctgcttctctgggccaactccattctcaaatgggctttccactcacggtagcaagatggcagtggcagtgtcacactctctttgtccccaggtcttccatctcccagccaaggcctggatttgagaaagcacactatctttggagagggcaggggtgggatcagttttactgaaagcatgtggaccgagagtggggaaaacatggatataaggaatgaaaaacaattatttcagaaacataatagctatttgttggttggttgtgccttatgtatttagttttttgagacagggtgttgctctgtcacccaggctggagtatagtggcacaatcacggctcactgtggccttgacctcctgggctcaagcaagcctcccacctcagcctcccaagtagctgggactaaaggcatgcaccacccccccagctaacttaaaaaaaaattttgtagagctgggattttgccatgttgcccaggctcatctggaactcctgagctctagtaatcggcccaccttggcttcccaaagtcccgggattacaggggtgagccactgtgcctggcctgttttgtgccttacttaatagagtaaagtaatgcagaaaaagactatcagtcacactctttgaggaagaatatttgctgtttcctagtttactgaaagtatcttgatggccttttcttggaaactgactactcataggtaagtaatgtcagtcactgaggatgtgttatagcacatataacacattgagggtggtgctgtgtctctctctctgctctgtgcgcatactcatttgtttatattattatttaaccttgtttgttactgtttttttcttctttcttctccactaccctgctaactttgaggaagaactttttgtctgtattcccagagcacccggaaggcactcaaatagatgtttgcaatgagagtaagtaaaagtaggaaaggacattgggaactcagcgacttggatttcagtcttggatctgcaactaaatagctgtgtgatcttggtcaatcccctttgctgctctgagctttggttctcacatctgtccagcaaggatttttgagtcctccctttactaagttcatagaaaggcaaactagcagagtagagagcaagacttggcagggcattctggtattttgtttcctgaggaacagttttgagaggggctgattactgttgtgataagaagtcttggtaagagatatggagggtagcgcctgaaagcctcaattgtattcttatgtaacattctctggaaaggtactaggaattaatattcctgagatggctgaggtgacttcatgtgtttgtgaaggggctaaaagcaggtgaggcagattgggtggaaaaagactggcagtcagaccaggttcccaatggggagcgcgggctgatctgctccacgtgctggcaacagagcctgtgggagatgcagctcctgccccctgggtgctggcacatcaaggagaaaggaaggacatgcctgtgtgactctcctgaaagattacatctgtctcctggcctgcccttcctcccccattttctccttagaaatgtggtattcatgacttaatcagagaaaattcctgaagaagaagatgaattttgaaaggaggaaagaaagggatctctggattgaaagcaataggctgaacacccccactccctcaccccctgtactctgctgactggtgaattccctggatgttctctgaagtgagggcagttttcagaggactgtgtcatctgcattggcaggtgttgtaatttggagtctacatgattgtcagcgtggcagggccctgcctgtttttgttaaatgatcagtatcctattagggctagtttttcttccagttgcatgcttattgagacccttcagcatctttctaaaaaggaaataagcctctttctaaatactaggacgagtatagttagtgtctcagctgtggccaagcatgggcaaggaggcagcatttcccaggggaagcttcatgggtgtgtctggtgatgctggatttgaattcacatataaaaacactccctggcaggtctttatctgacatcgtttggaaatggtgatctgccagtggagttcaatgtcatggccaagcctacggcccagaggggcagcttccaagatttgctttaggaatagtcaatgcagaatgtgtttaattcatacacacggggaaatggaaaccaagaatccgttcctccttttggctcctgtttgttgggttattttccccttcactggcagatggtgctcaacagaatatgctatgtggtggggttaaattttttaatctgtttttttcagtgagatataattcacatactgtaaaattcactcttttaaagtgtacaattcaattttttaaacatattcacaaggttgagcaacaatcatcactatcttaatttcaaaacagggaggtttaaatttgtcttgaatctctgcatgaaatatcaaccagaggtcaactctgattctcaggaaccttttaaaaaaattgggttcctcttgcaagggaagctgcaatttttattcaagtgtcatttttaaaaaaacataataagaaaaaatgatagaggacattggatttttcttagccctgttatgtgatttctttccgctattgatgatttttaaatcttagatcttcaggttggggcttattaccacagctttgttataataaagaatatttaaagcagaaacaataagactttttgtgttctcttgtcctttctcttctttgtcaagccatgcctctttagacagagcttagacctgtcttttcctcctttgtcaccatcacctagcacagtgcctccatacaggaaaggctcagtaagatttgctgaataaatgggctctactgggcgctcaggggaggctgtttggatgtatatatcactccaggtgactcatggcgaccttagtactttggctttgtgaatagccagggaattcttttgtacccctaagatatagctgcttctagaaagtgagagcttgacttctttccatgtatttctagggaaggaactggcaaggaccccaccatctccatagctcccaagtattctcatccaactgtaaaccagatgtgtaaagtcttcttgagttggtatcgtgaagcatggtgtaagtggtatgagtggtgtgagtctttgagtgtgtacacatgatgtgcacatgcatgatcgcctaagcacatgagggaactgtgaggagttcctctatgtttttaaattgcctctttcttctttctgcccttttgtttgttgataggccaggattcagaggggccttcagcctgggcacatggcccaggagtgctggtattcagtggcccattgtttcctgccccttgtgtgcatgaacggggactggggccagcatagctgccttcttggggaccattgtttgtctttgtaggagcagcagcagcagcgcctaaggcagcacatttttccctggatagaacaactgttctgtcttggagctgtacgcctaagagtgagagtagttagaatttcccttaatgcctgtatggattctttgaagatggtaacaagggaggcatcttcttctttctgcttcctttcttctttttccttcttcattctctttcttctttctttttctcctccttttccttctccttctccacctcctgttcttccttccttttccttcttcctcttcctcttcttctttttggccagttgtgagggaggggagatgctcatggtgtcatatcacaaataaaccacactagcaggtggtatctattaacagagcctcttttttttcctggatcaggggtggggatattgctttcttactgtctctgtcctctgggcttcctggtagacctcagggtgtactcacaggacaagaaaagcacttccccctaagctgtcctgtagagtagatctaggaagtggggaagggatccagtgtggttgtggacagattgaaacagagctagctggtgagtcggtgggcaagtccaaacttgtcttaggggcctgaatcaaccctcagctggaaagtggaaaaggcgatgttccaggagttaagagtcatggtcactgtgatttacacagagatactttcagagactccaaactggtgttctatttctcttgtttttgtttctctgacctactattaacctctttgacaagtcagacaaaccttaatttagctccagctcctgttgcataattgttgaccctttggtaaattacttaaagagtcttacttcagttttctccttagtgtaatcaggataattgtggataccttacagactacctgtgagaattaaatgagatgatacatagaaaggcctataaaatgtattcaataaacacatgctcccatcccttcagggttccagagggagtacctgtgatgcagcatatactctgctgccctcattgaggcacctgcaaaatcaggctggaattccttgctggctggatgtgcttgggggtttcttatattaaatcacatatctcagaggcctcctattaagtacttgttccttggacaggctaactctggagtggcctacttctggaacttcatgggactttgccttgtcctctctttttttggcagagggtgggtgtcatccaactaactattcctttgtattcccctggtgagtgagattactgaggtaaattcttaagtgcattacaggggactcagagggacctgacagccttactgcccatccatatcccctgtacatctgttactgattcagtacctggaaagcctttccaccctaaaaacgccttggttcttttttttgttgtttgtttgagacggagtcttgctctgtcgcccaggctggagtgcagtggtgcgatctctgctcagtgcaagctccacctcccgggttcacgccattctcgcacctcagcctccccagtagctgggaccacaggcacctgccaccatgcctggctaatttttttttgtatttttagtagagacagggtttcaccatgttagccatgatggtctcgatctcctgaccttgtgatccgcccgcctcggcctcccaaagtgctgggattacaggcgtgagccaccgcgcctggcacttggttcttactgaacggatggaatttaagtaatattagtaagcattctgaatgccctctcaatgtacagtctgcccacccaatgtctattactatcagcttttcactaatatattgaagggggacagatgcctacaggaatagtctcaacaagggctgttccctttaagagacccagaaatccctggcaagaaccagatgcctgacataacctctgcagatctttacccccaatacccttgtaatcagactccgtaaaacacagaacaagagagctttgatgagtgatgaggtaggcagcttttctgcacagccttctgtctgcttgaaacaatcctccggagctcagtttcagttcaggtgaggttactgcagggctggttggcattggtggttgacagggagagagatgaggatgaagagggtgagaattgcgcttacagatcacctgagatcatctgcaaaggacatactgatatttgtaaaaacagaaacaaaaatgtagatggggacagattgtggagcctcgactactttaaggcaaagctaaacgcaccatttacccatcctcattgcttcaagaacatttcagcatcatagttctgatcctgatttgcctctgatttatctgcagctcacgtgaaaactctagaccccctctccccataatgatgcattacatagcattacatagcatagacagaaagcattgttgcaactgtactatttgggaatgaatttggggcacacataaggaaaggcataatataggtgctccttttctgtgggattggagtcactgtcacatcctaatgcatttggagctgagcaggcttgcagagggaaaagatgaaagaaatggctccattctgactcagatggggattgggacataacttcagcaggatacacactgcaagccttctctgagctgaaaatcagtctggctttgtcatactgcttcctatgagtgccaggtctcttgtcagtaacaaatgcagtgctgcatttgaggcagatctgtttgcatctatagctgcctttgcagcagttccagagagagtgtttgctagctccatacaaggaccctgaccagccagaaatctgcatgctagagcttaaccagaagtatttctagctatgacactatagaggcactacagcatctatgaagattaagcaacacagatatgagtgatatttgttagtgaaaaaaatctctttccaagtcttcttaaaaaatgattttcattctgtgatgttggaaactgtgaaatctgattgacagtgaatggtttgcctgcccagaagttcttgtgcttcttttgttttgattgctaccatttgaccttgggagattttcttcctatctccgttaaaatatcctgaccttcatcctacttcatgaagatggtaaacaacattttgaaatgatggggaaaaatgcaaaaagtaggagcatggtctctaaagtcagtctcttggggtttgaatcccagcttcaccacttaaaagtttgacttcttcaagactctgttttctcatttttaaaatggggatgaggtagtacctgcctcataggatggttggggtgataattcatttgggccctctgccagaagacaacccagattctggctctgtgccactagaaacatagtaatataaatggtagataggaatgttattatttttaataagcagcttctcataagtgattcagcagattcctggttcacaatgttctttaatggtgtaaaaagggttggcatttttggaggtgcctcacatcctatggccagtttagactttaggcttttttgttcagggctttcaatttcccagggcacggggaataagtaagtggaaggtgggtgaatattggcatgcatggtggtttatttagggctgtctttctgactgtcttctcttgtttttgttgtagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacatgcagcaccaaggaccagcaattcaagtaggggctctgtggctattactctctgagaccttggaatatggggtccagggtggaggggggcagggtatgccacttagatccagctgaattcaggagcccctggcttcagattggttgaaagccctcaaggacttctcattttccagatcagtcttaagtgcaattcaacatttcgtagagatgagagtagatgatgaaccatgctaataataacagcaaacttgtttatagctctgttgccaggcatgctactaagggctttacatatatgttagtttgcttaatcccaacaactccatatgatggttattgttattatccccaatttatagatgaggaaactgaggcataaaaaggttaaggggcttaactcagggtctatcttaatctctgtctctctctctctctctctctctctctctctctctctctctctctcacacacacacacacacactcacactcacacacccctagtaaatagtagagctggaattgggctgcagggtctatatttttaaccatttcaccaaactgtctttaattagaagaaataaatgatgttgaggccattatatctaaatccctgtctaggtagctgctaaggtctatttcttctacatttagtttattttatacagctggcccattcacttggttcccagtgccattgccctagtttagatcatcatcttttttgcctgaatgattgcagtatttactatatcttctatagcagagattttcaaccctggctgcatattagaattccctggagaactttaaaaaaaatacagaaatctgggccccactccagaccaattaaatgagaatctctgggagtgaggcctgggtaacagggtggtgtaaaagcttcccaggtgattctaatgaacagccagcattgaggatcacagtccacagcaggggtgtccaatcttttggtctccctgggccacattggaagaagaagaattgtcttgggccacccataaaatatgctaatacaatagctgatgagcttaaaaaaaattgcaaaaaaacctcataatattttaagaaagtttacaaatttccgttgggttgcattcaaagccatcctggcccccatgcagcccacaggccgtaggttggacaagcttggtctacagtttctctccattccaatctgcctgctccattgtgatcggagttaatcttcctggaacacactggcgatcagagaatttctttctgcaaaactttcaatgtctctccattgtctatgttctttttattatgattattattatttttagagataaggtcttgctctgtcacccaggctgaagtacaatagcgtgatcttggctccctgcagcctcaaactcttgggctctagtgatcctcctgcctcagcctacctcctgagtagctgggactgcaggtgtgcaccatcatacccagctatttttattttattttaattgttgtagagacagggtttcgctatgttgcccagtttggtctcaaactcctggccttaagtgatcctcccacctcatccttccaaagtgctggaattacaggtgtgagccaccacacccagcccatctatgtttttgatatcaaattgtagtttctcagtgtcagcttcatctgtactgttagaaatgcagtatctcaggtcctactccagtcctactataacaagatcccacaacatagcatgtgatttgtgtgcacattgacatttgggaaatgctgttccattcacaaaggtgcacactttttggcttggtctttaagcccctctacatctggaaagcctcaaacaggtttccaaccttatttcttgtttctgttccactatacccgagccaaacagaacattcactccagtgagtcactggcatcctgttacttgaggttatgtggtcagtctttccatctttgcatgtctaagtcatgcccatgtcttaagacccatctcaggtgctccctgttccaggaaactttcctgattctcccagaaggaagaaagttctccatcttctgaattcttacagcattttatttgttcttctcttagggcattcagcactatctaccttctgttatcttctctgagtggactgtataagtttgtttgatcttctggtgtcccacagtgcctagtataatatgtggtgtatagtagatgctcactaaatattgtggaataaataaatgaatgaatgaatttgaaattagtgccaagtgtatcttattttccccattttctatttttgtttattgccttaataatacaggacacaaattatcctttaaaagccagctctgtgcaatgaagatggggttaaggttgaggagaacatgacatctcaaaataagccagaatgaaaatttcctccagatgtttttttcctcagagtttcttatctttcccaagtcttattctctttatgataagagaatcatctgataaaaaaatgttattttagtatgtgataaatgaagacttaggggaggaatcatttgctttagaaaatgattcaaagttggatttattctgttggtaatctcatcctaaatttaaaatagcatttgatttttagtactgtatcatattctcagcttatggacgtatttgttacaaattaaggttcagatgtgttaatctccaagtcatcttgtgtccggaattggtgggttcttggtctcactgacttcaagaatgaggccgcggaccctcgcggtgagtgttacagctcttaaggtggtgtgtctggagtctgtcccttctgatgttcagatgtgttcggagtttcttccttctggtgggttcgtggtctcactggctcaggagtgaagctgcagaccttcacggtgagtgttacagctcttaaggcagcgcgtctggagttgttcgttcctcccggtgggcttgtggtctcgctgggctcaggagtgaagctgcagatctttgcagtgagtgttacagctcataaaagcagcatggacccaaaaagtgagcactagcaagatttattgcaaaaagcaaaagaacaaaccttccaccgtgtggaaggggacccgagcgggttgccaatgttggctcgggcagcctgcttttagtctcttatctggccccacccacatcctgctgattggtagagccgagtggcctgttttgtcagggtgctgattggtgcatttacaatccctgagatagatacaaaggttctccacctccccatcagattagttagatacagagttttgacacacaggttctctaaggccccaccagagcagctagatacagagtgtcgattggtgcattcaccaaccttgagctaaacacagggtgctgattggtgtgtttacaaaccttgagctagatacagagtgctgattggtgtatttacaatctctgagctagacataaaggttctccacatcctcaccagagcagctagatacagagtgtcgattggtgcactcacaaatcttgagctaaacacagggtgctgattggtgtatttacaaaccttgagctagattcagagtgccgattggtgtatttacagtccttgagctagacataaaggttctccatgtcctcaccagagcagctagatacagagtgtcgattggtgcacttacaaaccttgagctaaacacagggtgctgattggtgtgtttacaaaccttgagctagatatggagtgccgattggtgtatttacaatccttgagctagacataaaggttctccacgtcctcactagagcagctagatacagagtgtcgattggtgcactcacaaaccttgagctaaacacagggtgctgattggtgtatttacaatccctgagctacatataaagactttccacgtccccaccagactcaggagcccagttggcttcatctagtggatcccgcaccggggctgcaggtggagctgcctgccagtcctgcgctgtgcgctcgcattcctcagcccttgggtggtcgatgggactgggcgccatggagcagggggtggtgctcgtcggggaggctccggccgcacaggagcccatggagtgggtgggaggctcagacatggcgggctgcaggtcccgagccctgccccgcgggaaggcagctaaggcccagcgagaaatcgagcacagcgccgatgggccggcactgctgggggactcagtacaccctccgcagccactggcccgggtgctaagtcccccattgcccggggccagcagggctggccggctgctccgagtgcggggcccaccaagcccaagcccacccggaactccagctggcccgcaagcgccgcacgcagccccggttcccgctcgtgcctctccctccacacctccctgcaagctgagggagtgggctccagccttggccagcccagaaaggggctcccacagtgcaggggggaggctgaagggctcctcaaatgccaccaaagtgggagcccaggcaggggaggtgccgagagcaagcgagggctctgaggactgccagcatgctgtcacctctcaatctgaattgttctaattaagatcacatactaggaatagggtgatttctccaagtttagaagaattgatttattttctgataaagatggtgcttggcaacattttttcctcaaataaccagtgagtatttattgattgaccagttctgtgcttgtacaaggcattggaaaatacaagagaagtttagggagtcattatgtggttggagagaagattttgaatacaggaagcaattagagcataaagcagtaatgatctcattaattggtgttatgtacaacatagatctgatgagaggtcagagatggttaaaggttctggaatagtctggaaagttgtcatgaagcaggtgggacctaggcttgagaggtagatttgtgtggcagaggagagaacagcaagtgcaggtgagaggaagcaggaatatttggtgatgagagggtgtaggggctagtgtgggatccagctttattaaagggaaggttcctaacacattcatctaactgatttccattgcacattccttgaactcctttgtgccttggagtgtagcagggaacaaactgctacacttagcacttagcacttagatgaagaaatgggcatttaacaaatcacacaattagatatgtaatttaaagttggggtaagtgttgtggaaggaaagtatttaatacaaggtggcacaagaacctggaagagggcaacttttccactttatagctggtttactccaatagcttcctgcctgatcatattctgggtaacaatcagtctacttattcaacaaattacttttaaatacctactgagtactgtgctctgtgttgattcctataggaactaacataaacttaggaattcctgtttaagcggagcatggtgacttatgcctgtaaccccagcactttgagagggtaagataggaggatctcctgaggccaggagtttgagaccagcctaggcaacatagcaagaacccatctctacaaaaaataaaaaattagctcagcatggtgatgcacgcctgtagtcctaacttctcaggaggtgggaagatcgcttcactccaggagttggagcctacagtgagctatgactgcaccgctgcacaccagcctgggtgacagagtgagaccctgtgtctaaaaaaaaaaaaaaatccctggttaacagggaaaagagctatgtaaatagtataatgtgaaaagagctttagtagagatatgagaacacagctattttcaagagcagtggaaaataaggttaaataagtagagtagaccccaaatgatagccctttgatagcaagcagagaagttcagattgggtgtggcagcattttagtgggtcctctgggttcttaggtggggagagagacacgaggaaaacagaaggccaggatgaaggttttggagtaatctacacacaaagtaagagcaaaaaaaaaaaaaaaaaaaaaaaagtggggggagtggaaaggaagtaggaatatattcagaaggtattcaagaaactaaataggactggataactgactggataaagcatagaaccataatggtcagaggtgacccagtgtctctaccctggtgacctagaagaattgtggcattcacgatagaagtgggggtgttgagggaagatctgttttgaatggtgatcctactttgaacattttgggtgtagagcagtacgaggccatcaggtatccaggtggagatggcatactgctgaggtaagaggttatgactggggatagctagcagaatcttcggagtaaaagtgattgtgggagagatgaaagtatatgaattcagggaagagaaagaggagaacaaagagctaaatccaggaccccaggcttagacaataaaagttttgcattggtagtaaaagttactatgaggagaagcaaaagctacctgaagagagagagaatagttttgttttttaaggcacagggtagaaggtaaggtgggaaagtggcgtctgatggaactagaagtgttttaagtagaagatctgtaagagcaatttcttattgatactctctcatgtataaggtattgtgagagatgcaaagatgactaaaacaagccccaaacccaaatgttttcaatctcttagggtgaaacatatgaaattgctggttttttttgtaaggcaaaatggcaatttcatatggtacagcctggtagaagaggagatagaacatatgtacaaatgcatttaatacaggcaaggtggtgagaaactcaataagagaggctcaggcaacatcctactttcatgcataatttattcctaaaagtgtatacagaagtcaaatggttgaatgtctaactacagttttatgtggggtaggtaggttctattattataaataagtgtatatgtgaaattccaaattatccctcacctgatatatttttagcattgtataccttgtctttagttctgtttgtttttccaccattaaactcatggcctgcctgctcaagttcagtgaatacctaaagagtccacgtagctgatgagttctgcccttatcttagtagtacagtgatgagacctctacttctcaatgcctcaatgcaacattagtaacagcacttttgtttttccatttccactcatttttgtgttgcaaaagataaccaagtgttaaaatgtgtgcacagcacaagcattgctgtgcagagacaaccatcctgctgaaacagaattggtacctggcagtcagcagcactaagacaagcttgaaacatttgctggcaactgaaaatttgacattggcataggaaaggcatcttaggcatgtctgatttggtaaagatataagtttggctgatgtaatagaccccaagtaataatggcatacacaagatagaggttgatttctctctgatgtcatagtctaggtgttagccatccagggctgtcaggcttcttattccatcccgagagtgttatccttttctgtatgacccaagatggctcactgccaccatgttctcattccagccagcaggaaaaggcaacaggacgaggggcaggtatggccttattttttaaaggtgcactctggaagtggcacacacagctcttcaactcatatctgactggccagaacttagtcacatggttatgctgaactgcaagggaggctgggaagtgtagttattgttctgggtgactataaagtagagtttctcttaatatagaagaaggggaaatattgggggacaatcagcagcatctgccatggtgtatgaaaggacaagtgtaggaaagaccatggccacccatccatacagagtgccacaggtgcacaaagaagagagatttcttctgattggaggactggagagggctttagggaggtcaagttcaatggatgggagataaaaaaattaaagtgccaatgctaggcattgatcctttaagcttaatacagttgagacaatggagaagttgtagaaagaaggtgaaaagatgggaaaggaagcattttagatagagcagtattagaaaaggctaacagaagtgagaacaaaggctgatggataacttatctgttttgctgaagaacagtaattataaatgtgatagtgaaataaacctggaaaagataggggccagaagattaaagaggtctatgaatgccaggcgacagggttcgggctttattctgtaagcatgggggaccattgatagtttttgagcaaggaacataattatggctgtgctttcgaagggtaactatggcaacgatgcatatgatcaattggagcagagagactggaaggaggaggacctgttaagaaaggagtccagtggtgaggttaatgtgggctgaaactgaggtcatacccttggaaatagacaagatggggccaagtgtgaggacaagaatcaatggaattcaaagaagctgggacagagaaagtgctcttggtttcctgggtctctggagtgacaatagtactgtattttcattcagtcggtgaactgtagccttgattttgctgactctaggactggtcccagaatagttcattctctgcccagaacatctcagtgggcactcatcacctcccccggagctgtagcagctgttgggctagcaatgccatgaatttgtcttcctgtactgccaggagagcagctgccagcagcaactctgaacagacccatctcagggacgtggaaactattcaacttgggatgcagcaggttggccagggctgaattcagtccacatggattcatctcacccttttccaggccactttcttaccctggctgggtttcagccactcatactgcgttaggttgggtattttcttacagttctaagtgattgcatttagggatggacgctgctgaactgctttcttcatcttttggacacctcctcccctggaagccattacgctgtcagcctttggctttgcttcctactctgctctgctcctgctcaccttttgtcctctcccacattgcgctcagtgcagatatcctcattaaagcctgtacagttctgactccatggcagcctgaccctctggttccatccctctccttctttctccttcccccagagaatgagagatgctgcagatagaactgtagcgattatttgaccctatgttattctgctttgtttaagacaggtaacatggctttccccatccctgtgaattgtgggaagaccctgctaatgtctgaaattctgtcagcctggtttgattaagagcagtggtaaagtattatgcgagggtaggaagcctttctagggaagatgttcttgcattttctttggctccttgaagagcataaatgtattcctatgcgttgctgagcctttgattgtctcttttaagtggaatctgtgttaatatggcccagcaggactctaattgataatgcattggctgtttgtttgttttttttttaaatagacttgctgtaaattacctttcagtcatagctcacttggttttgatctcctgcttttaatagctcattttttaggtagcttttttttttctgttgagtttttagagcaatacttctacatttctgtcctgctgtgttccttgcagagaccttctgctattttataacccactgtcagtatcttttcagcgtttctcccagcttctttctctcctcaacacatatttgttgactattttagaggttttgttctaaactcttagaggacagagatccaaagaaataaaaggagtagttctttcccatatgaaattataatctagtcagggagaaattaaattcaaatacaagaatacaaatcttcaacataaggctatatgtagtaagtactaagtatatgctgcagaagagatgaggctcagttgatgtagacaggaaacttcagtaaggaaatgagatttgaacaaagctttaaagaaaatggctcttgagagggaggggaagatactctaggaaaaaggggcacagctagaagaaagaacaaagcacttttgaggtacagtgagtagactggtttagctgggagaataagtggatgtggaagaagtggacaaaggtagatgggtttgtattgtggagggccttgacccttgattagggatttggctctatgcaatagacactggaaaccactgatggtttaaataagtatgaattctgattaaggaagattaacctagtggtagtttgctaaatgacaagaaacatgagaccaaggaaaccagttgctgcagtagatcataaggatctaaattaggttgggatggtaggaatgaaaagaaggggaatttatccttctgtccatttagcaaatatatatcttcttaccatgtgccagacacatgccagatacccacccctgtactcctagagcttacagtctagagacagacggaaagcacctggtgcaggaagaatctacaggaattgctgactgatgggattcaggtttcaagtgagcttggaagccataaaagaaagaggtctgtaaagtgtctttttgacttgggtgattgataaattaatggtatctttaaaagaaatagagaggggcttttttgttttttttttgttgttgttgttgttgttgttgttgttgttgttgttgtttgggtttttttttagatggagtttcgctcttgttgcccaggctggagtgcaatggcacgatctcagctcactgcatcctctgcctcccaggttcaagctattctcttgcctcagcctcccgagtagctgggattacaggcatgcgccacgacgccaggctaattttgtatttttagtagagacggggcttctccatgttggtcaggttggtcttgagctcctgacctcaggtgatccgcacaccttggcctcccaaagtgctgggattacaggcataagcctctgtgcccagctgaaatctagtgttttttaacagaagttaggagaaagaattgtttttgaaggagtaaaatatgagaaatttggttttggattttaagtttaaggtgttggaagagtattgaagctaaaatttctagtagttgacaaaatgaatggctgtatgcagggctaaagagattttttggctgttggtagagatttgcacacgtgcacagaggggatggttgaaactgtggaaatatttgtgatttccaatagtaagagtttagaagaacaaaggggaaacttcctttgtatcatctgtgatactcagattacagagtgtataaaggaatttaaatgatatatttatttgtgtatcattgagtatacattttgggaacctaattatgtatcaggaattgggtttagtactggagatagagaagaataagacaatctcctattttcactaatattaaattagcagaatatcaaggaggtagacatagaaagtaaactttcttgtttggctggttatcagttgtgtcactattggaagtgatgtgagggagcagggcctaggtatcttaagaatttggtagacattcaacctgcaatactcctttcagtgggaggttagttacacaattaattaaagaaaaattattgtagagtctgtgttctcggcttcaggcccagtatttgaatgtgcgccatctctgtagttacatcactactgcggatgggttcctcccctggagttgagttcaaagtcattcaccagtctcacaggatagcattgggttgaaaagcatagagtcagttggccatggaaaatgttatagttgtggttgcaaatcggaaaagggtggaagaccagaaggttcctcattgacttatggagtgaccttgagaaggaaagtaccaggaaacatgaagctcccgggagggaaaacccctgacttcctgggaccagtgcatcactcactcattttggacatatttgggagctgtttgttccctcaggaaagattttgcccagatgtagcatctggtgttgcaagggttggcttcccttctccatggctcaagatgcctttgttcagaaattaacagaaggttctttggtgtgttttgcatgggcccagttcatgtagaaccttaggtcattgttgagtcctttttggaggaagagttgggaggacttctcacacatgggtaaagcagaatggaagagacgcaagaaggccatttgggaatcagcaagacagggtgatccagtctttggaagagagaaagaattcagttaaaagttctttgggaagctttgtgactttgtgtgggaaaaaccagagctttgagccagaaaaacttgggtctgaatcttgtctcttctactcctagcttgtgaccttaagcaagtcacttaacccctgttagcctcaatttcttacctgtgaaatgttgacagtaatacttaccttgaaggatccttctaaggatatatataatgtatatacagcactagctaatgtttgtgacttaatggatgctcaataaatggtagctgatataattatcaggaaaagtcaatcctgatagttaagatcagccacagaagagtcagccctgatagttaagatcacaagttctgggaaccagatttcctgggttcacaatcctggatttctcccacttacttgctgtgtgattttagatgaaaggttttaatcacctcagtatcctcgtttgcaaaatgaagataatattcataactaccttatggagttgttatgctggttaagtgaattaataatatgtgaaacacttaggacagcttggcacatagtaaatgtaaatagtagcaactattatccctatcctcaggatttgggcctgagcacagctgtactgggtaaaacactggtatattagatacactagtcattccttgtgcagagttaagtattcctaagcctggctgggtaatatgtcagtttccattttcttcagacccctgtgggccctcatgaatgacaaattcatcccctaccctgatttttatggtatagctacattgggcaggacataggcaattatgtgactctgtgtaattgcatggtcagtccctataaaaactcagcaattgtatgttttgttctgtaaggtgtcatatagttcaaccttggtgggttacttttagatccaggctcataatcatgaagaggaagacatttgtcatacaaccactctctgattttctcgtcctcttggagttaatagttagccctattgccaaattgctgagtttctataaagatatactgttgagacccacaggtcccaattttgacttgggcaaataaaagaaggccagtcctattcagcctcctgcagtatctaccatcgaggccagcaggccagtgcagtacaaaccttagtcatgaacataacagtatgtggtttactgggttgtttgtctcatgaggccaaacagaagctcccaagcttctgcataaatggctttatatcttccttttagggtagggaatgataagagggcaggttagaagcaaaatatgcttttatgagcaattgggaggatgttggagactcctgagagtttcctgtgtctcctaggatttgccactggaatgtcagcaggccatacctcaggcgttcagctccatggagcaaagacagtagtgatcacgttccttgacaacagtgctagtgtgcggggagcttttagttttccttttctctgctcctgtaagccccataataattctgtagcagacacaggaagcaatgtgtctaactactactaggcaatgtgttcttgggatttttaattctcaggaattcgcagccaattaaatgaatttactttgatccagttctcttttcaaggcaaaagctgtgtcatcttattgggagctgactgtgttaagtgggaagggtttacaagataagaagaaaagacagtctctgccatacgtgtttttataattgaaatgggggaaatcgggcaggctgagagagaataataagaacacatgtgcacaggaatttaaaaatagcaccccatttaaagcaggttccagtagtcaccaggaaaagaagaaaggtggagtactcaggagggacttgtacttggttcagtcagggaaaggtaaaagatagtatagttatgttctcaattagatttgttccctggttaattgaagtaaagactttaatatctaattcctacactgcacagaagtatcacacattgaaaagaaacagtgtgacatgggaaggactcactgttaacgaaagatttagagagaatgaaaaaaaaagtaggatttgggtttttcagagttgaaataggttcatcttttctgctagctcctccttttatacatctccactgtcgttgctccttgggttttaaattcagggagaatcaatgagcacagttctgcgtcttaatatatttagggtgcagctggttaaagagccaggattagaaaatgaatcgaacaaactaggattatcttcaacagtaggatgctgagctgtgtttgctgattcctgcttaagcagtcgggacagggcatccttgcatgaaattcagacatccctccctggcagcctctgtggtaaagtagaggttgcagaacaagtctggcagctctcagcccgaacccttgtaaacaacagatgttcataactaagttctagggtgggggtaggggttattgttgatgcttgaaattctttgaatttataggcagcatctcagggatttagcaaaaggaggaagttatacagaattgatttctgcagtgtacaggtagaaatgatgcctcatggatttccttgaagacaaagcacaggctattgtgtggactctaaaacagagcaaggtgaacccaggaaggcaggcacagttaagaaagggttggcttcttacgtgtattgacttcctcccctccttctcctctctcactcctttttatacattgactggatttgtcagtcttgttcttgctcctgttttctccggtaatgggtggaaatgtgtgtcctttcttaccacagagtcctagatacatgtgcatacaaatacacagtgtattaggccattttttgtgatgctgtaaataaatacctgaggctgggtaatttctaaagaaaaaaggtttgattggctcatggttctgcaggctgtacaggaggcatggtgctggtgtctgcttctggtgaggcctcaggaagcttacaatcatggcagaaggcaccggggagccagcatgtcacatggtgagagtgggagtgagagtcgggggaggtcccagacttttgaacaaccagatctctcgtgaactaagtgagcatgaactcacttatcaccacagagatggtgctaaaccattcatgaaggatctacccccatgacgcagtcacctcccaccaggccccacctccaacatttggaatcacatttcaacatgagatttggggggggacagacatccaaaccatatcacataggaggaaaaacacacaggaagagcacacaggtgcacttcccttagtgccttctgaaggacgcaactcaggtttttatgatatactgattaacgggttattgttatgggctttgtcttggattttaacctgatactttctcagtgttggttttgctagatgttcattacttcattaaacagaggtgccgggtgcggtggctcacgcctgtaatcccagcactttgggaggccgaggcgggcggatcacgaggtcaggagatcgagaccatcctggctaatacggcgaaaccccatctctactaaaaatacaaaaaattatccgggtgtggtggcgggtgcctgtagtcccacctactcaggaggctgaggcaggagaatggtgtgaacccaggaggcggagctttcagtgagtcgagatcgcgccactgcactccagcctgggtgacagagcgagactccgtctcaaaaaaaaacaacaacaaaaaacagaggtgagtgatgagaatatggcttatgaagacttcagtgctgcctcttcttgatccccatcccctagtccccaagcacacataccaagtttccagccagatgataagtgcttaggaaaccttctactttacagcatagttcagggaagccataatagaaaaaatataatacatctttggtaggcttccttggcaccaaattgacgaagactttagaaaggttcttatcgtacatcagatgaaaaaaagcgatttaccagatctgggaatgtttttgagccactctagcaaaaaacaactggcttgaaaatctttgataaaatcgcttattcttttggaagctaagaacatctttgtacaattttttgttgttgttgttttttgttttttgagatggagtctctcactctgttgcccaggctggggtgcaatgatgccatttcggctcactgcaacctctgcctcccaggttcaagagattctcgtgcctcagcctcccaagtacctgggattacaggtgcgcaccaccatgcctggctactttttatatttttagtagagatggggtttttccacgttggccaggctggtctcgaactcctgacctcaggtgatctgcccacctcgacctcccaaactgctgggattacaggcgtgagccactgcgcccggcccatctttgtactattattccttctggaaaagaagtccacttctggctgttttgtccatttgtacgaatttggtgaacaccaatcctggtatgtgaggttcacttaatctttcagcaaacatttattgaacatttattctgtgccaagagttgtacaaggaattaaatatacatagaagaataagctaccattctagcccatgggagttattacttaatgtgaaatattttaagtttgtttatatacatttgtatgtgctctgataaggcgtagacttccaggttgaggagacagaattgttgggttatgagtcaccctgttagtcacctttattatatgtgaatcagtaataaacacttgacttcattctcatcgctaatgaccaataggttctctgcaggtttggggtcacaaagaggtgtaggatcctgttctttccctcaggaagctcatggtgtcatgtggaagacagagagtttatgggaaaaagataacacaaaataatatacacttactgccaaaggagagatgggagaaatgatttcatttttcttcagaatgcaatctgtaaacagttttaaaattttgccataatgttagacttacagaaaaattgcaggaatagcacaaagaatttttgtatactaccattttatccagattgccccaaaatgttaacatattactacatttgctttatacttcacccttttcatactcaattctcacacacatattttgtttttctgaaacacttgagagtaaattgcagacatgatgaccttttatccatacatactttagggtgtatttactaaaaataaggatgttcttttgcataatcgtagtgcagtcatcgaaatcaggacatacagattgatacaatactattatctaatcaatagacattcagattttaccagttgttctaaaaatggccttttttggcaaacgaaagtccaagattatgcaattcattcaattgtcttatctctttactttcctttaatgtgggatgatttccaagtctttatatttcaagacattgacgttggccccgttattttgtagaatatcccttaatttgatatttctggcaatttctgataatttccttattattagattcaagtcacacacttttggcaggaataccataaaatgtaatgtcacgttcttctcagtgcatcatatcaggaagcacttgctgatgatttgtgccataactgatgatgttaaatttgatcatttggttacagttgtgtctgctaggtttctccaccatgaagttgttctataagctttgtaattaatgtatatattgtggagagatactttgagaccatgtaaatatcagcttacccttcaactcttatactcactagttttagcatccattataatttcttgcttgaatcactttctattatgatggttaccaaatagtcatttttccagttttcatcattccttctacatttatcagttgcaattctactgtaaggaagagcttttccatcacccccactttttggtctggttgttggtttatatcagtgtggacttgtggattattattttattcaacaggttataatcctttaccatctttattttaatgttcatattgttctatatttggccaatggagtcccttcaagctggcttctgtgtcttattgatatgtccccatcgttctttgagcacttccttacttggtggcacaacaagatgttccaggcttaacttgtactttccttgcctttactgtggagttgaccattttttcagagagcctcggttgcttttagtgggaaatggtatttagaagccatggatgctaaatatgctctttgtaactgaagtaccattatttatagtccctttcagcagacagaggtagtagatatatgtatgtacacatagacacatacacacacacacccatgtacttctataaatagctatttctttatctgtctgtatatttatatatattaaagcctatgagatcatatcagtatctttcattccaatccaataccacatgttttatttaattttctcccctttcctgttctctgaacagtgagaaacctggttcctattatccataacacacattttcacttaattgctcagtcctagagtgtacagaaagttgtttcagaattactaacccaggctgggcgcgatggctcacacctgtaatcccagtactttgggaggccgaggcgggccgatcatgaggtcaggagatcaagaccatcctggctaacacggtgaaaccctgtctcttctaaaaaatacaaaaaaaaaaaattagccgggcatggtggcaggcgcctgtggtcccagctactggggaggctgaggcaggagaatggggtgaacctgggaggtggagcttgcagtgagccgagatcgtgccactgcactccagcctgggtgacagaccgagactccatatcaaaaaaaaaaaaaaaaaaaaaagaattactaacccatgcctctgaaaaagaagactactgactagattttaatactggtttagagttctttttgttattagccttgagggccaagacacaatgttcaaaagttagctgactagttctttctttcctatcttagtctgttttatgtcgccataacagaatacctgagtccaggtaatttataaagaaaagaagcttatttggctcacgactgtggtggcttgagagtataagaatgtggcatcagcatctgctcagctcttggtgggggccatgtgctgcctgacaacatggcggagaagctgaaaggctagggaatgagtgaaaagaaagcaaacactaggaagaagcttgctttacaacaactcactctctcaggaactaatccagtcccacaagagtgagaactcatttccatgagaatattaatcttattcatgaaggattcttcccatgacccagacaacccccagtggtccagcctctcaataccacttgcaattgcaatcaaatttcaacatgagttttggagggaacaaaccagattcaaaccatagcatccctcaatctccagaccttcaatgtagttatattatttgtttgaaatataatttggtttatttatttgtttgtatttaatgttttcctctccggaatggggtcttgacatttctcactgccaaaccttttctcttgactaaaaaagatggcgcagattcaggagaagtgagagacccatgtatccatagattaagtcagggctttagcagaagtcagtgatggggacataggccagacatgcactgagaacaaaccaaccattttcccctacttctggaccagccctgtctctaagcaagccatcttatggattgagacccttgccagtttctcctaagcctgctcctaggttctccttgccattctccctgatcacctcttttgcatttagtgaaccaagaatccagcatcagcatcagcatcagcatcagcatcagcatctgctcagctgtaggccatgattgtctgtactgtttaccagcagctcatgtaatatgcttgatgtaagaccttaggataatgttgatctggcctttcagacatgaagccccggggcactgcacattgacacccaaacttgcaaacttttacgtccttttgcgagactgtttgctagtgccctgttctgaaatccttgaaatttctcctcctggactttcttcagttacatgctttggcctctctaatagctcttttgcatcaattctgatgacctggccattttctcctgtctgtctgggaatggcttccagaatcccctttctctgccccatttaaccctcttcctccatctcccacacactcattttatttctctttcctccagacacatataacctggtcagtgctgctgattccagctgttctgaatcttgtgtacagcttaagttcaaaaacagatgggcccaaagtatcctagatgctgtgccaatttccactgcatgaaaacaaattactgaaaagcatcaggaaattttagaatagttttggggtttgattctctatcttctcaatggtccttcctccccaactcttccatttctcttcaccgtccctgtccccccattataccttgccactttccatctcttcttcatattcctcacttagcaaaggctggtttttaaaacctttattctcatttttactctttctatgtactgataggtttaaccatcaggatgggactgtgttgataatcaagctatggctgttggttgtttttctagacgtttatacccttttaaaatcttccatctaggactagggaccttatgtcctatgtccttttcatatagagaaggtaaggctggggcctctgtgtctgtgggtacatttgtaggtcaaataattcaccagcttgcaaataaagtagatattcttctattgactttatcactggggggtgcacaattgtgccagtgccattgtctgcccttgtcgggagtgagtagacactccctgtagacagggagtgtgttccttggaaagcagtgacattggacccacaccattgctttcagaatcctcattctgggaatttgccaactgctttctcccagtgttctgtaggacattgtttagctttggcattcctagtcaccctaaaaataagaggaaaacaatcatcgtagttggaccacttatcttacaggtatataaggaagacactggggtcatttacagagcatggggagaaagctgttggcatggtacagtggttattgggtgcccactgtgaacagacattgtaggaactgtcttcaagagaagcccttgagggataggcttctagaagttcaggtacatgctggatttatctatgcaaattataatgtttccccgcttccctccctccctccctccctccttctcttctttagaagagaatcctcagattctcaaaaagtatcaagcagagtcctatggatggtaactgaaagaaaaaaagaaaaaaacgattctcaaagggatctggaatacgtaattatctcccataatttaagaccattactctggagcagtgactttaaaacattttgatcatgaatctccatattttatactacaagctggaatatacttatatacacataaatagctgagaacaatactttcacagaacaatacttatgtttgctttgtgtgatgtactctgagattttctactttgttctgttattcttttttttgttgagatggggtctcactctttcacccgggctggagtgtaatggcgccatcttggctcactgcaacctctgcctcctgagctcaagtgatcctcccacctcagcctcccgagtagctaggaccacaggtgcacaccaccatgcccagctagttttttgtatttttggtagagacaaggttttaccgtgttgcccaagctggtctcaaactcctgacctcaagtgatctgcctgcctcagcctcccaaagtgctgggaatgcaggtgtgaggcactgcatccaggctacttttttctgttattctcttctactgttgcctacttaattttttgagaaatgctagttggtgacctatacgttgattttttttaaacctcactaatgggttgaatcccacagtttgtaaaacattgctttaagagcattgttttttaaattttttggtgtgcataaaattacctgacatgctgatttgaaaggcagattcctgggcatcagtccacgagttgtaatctctggcagacgagcataagaatccacattttaaacaagcattccaggtgattctgatgcaaggtgatttggggtcttgaagcctcacacttacagaaactgctctcttttgcatttatgaacctggctgttgaaggcttcagatcacatgcttggggatggtagatactagtggggatcatctgactccagactgggaatcttctcgttacaggatgaccccaatcacttaggtttacttctggatcttgataattccttgatagtcctcttttactgatgtctcttatggcccttaagaaggcagagaaggggttaactgaggccacagaatagagagagtgaaggaactgaagggtcattttacagagtgactggggtgtggcccagtcctccagtaggtgcccagagccagtccaaaattagaatggggtgggattcaaaactgcttttcctattcacttgcctttcatgtgtaaccacatgcagtgtgtcaacatgctttcaggcgccgttaggcagcagcagttttgctccctctgggttcatggacccttggtattcctgttatgtgttgtcttagaatagctctgcgctctggggctctgagcattgtccattaactctttcagcaccagccctttgagatgctaagggcttttgaatgaaatgtaataaccaccacaatgaaataagaaaacggttactagtcaggagacctggattcttgccctgctccaccactgtctgtgtgatctcaggctccctgagcctcagtttcctcactcagacaatgacaggcttggtctagactctagaccatcttgaaagtcccttctagctctgaaattccatgattctctttttgtacactctggccttttctctttgcacatgattctttcgtttaaagtctcagctacattaggcacagaagattcactgagtttgggaatttccagagaatcagatgataaattaatagcaataaaatgtattcctggccaggtgaggtggctcataattgtgagcctggcactttgggaggctgaggcgggaggattgcttgagcccaggagtttgaggctacagtgaaccatggtcatgcccgtgtactccaacctgggcaacagagcaagaccccatctctgcaaaaaaaaagtatgggccgggtgcggtggttcacacctgtaatcccagcactttgggaggccaatgtggacagatcacctgaggtcaggagttggagaccagcctgaccaacatggagaaaccctgtctctactaaaaaacacaaaattagccgagcgtggtggcacatgcctgtaatcccagctactcaggaggctgaggcaggagaatcgcttgaacccaggaggcggaggttgcggtgagccgagatcgcaccattgcactctagcctggacaacaagagtgaaactccgtctcaaaaaaaaaaaaaaaaggaagtgttcctatttagtatactaatgaagtagggaatttatgaaacaagtttattataaaaggaattttgagatgtatttgtcttttcagacatgattctagtcactttgtttcgtgggtatgaattcattgtgtgggctgttgagtaatgatagttgtcataattataagaaaagatgttgatactgatatatagttgtagaacactttcatgtttataaagtttgtttaagggcatcaccttgtttgattggatcttcacaaaagtcatgtgtgttaggcagggcaggtctgctgtccctgcttatcccatttatttatttatttattttttatttatttatttttttaaaagataaacagttattcatttttgtttaagacatcaggagtactaataaagaaccaactggtaaactgctgataattccatataatatatctagcactacaactacactgaatcatgctttttttttttttttaatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcaggatttatagtcatttgggtatatacccagtaatgggatggctgggtcaaatggtatttctagttctagatccctgaggaatcgccacactgacttccacaatggttgaactagtttacagtcccaccaacagtgtaaaagtgtttgtatttctccacatcctctccagcacctgttgtttcctgactttttaatgattgccattctaactggtgtgagatgatatctcaatagtggttttgatttgcatttctctgatggccagtgatgatgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcaaaaattttctcccatgttgtagtttgcctgttcactctgatggtagtttcttttgctgtgcagaagctctttagttttatgagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagtttgaagtcaggtagtgtgatgcctccagctttgttcttttgccttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttatatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgctctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattttgatgttagggtgtcaattttggatctttcctgctttctcttgtggggatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgtgggtttaaagtctgttttatcagagactaggattgcaaccccttcctttttttgttttccatttgcttggtagatcttcctccatccttttattttcagcctatgtgtgtctctgcacgtgagaagggtttcttgaatacagcacactgatgggtcttgactctttatccatttgccagtctgtgtcttttaattggagcatttagcccatttacatttaaggttaatattgttatgtgtgaatttgatcctgtcattatgatgttagctggctattttgttcattagttgatgcagtttcttcctagcatcgatggtgtttacaattgggcatgtttttgcagtggctggtactggttgttcctttccacgtttagcacttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatttgctgttagtctgatgggcttccctttgagggtaacccgacctttctctctggctgcccttaacattttttccttcatttcaactttggtgaatctgacaattatgtgtcttggagttgctcttctcgaggagtgtctttgtggcgttctctgtatttcctgaatctgaacgttggcctgccttgctagattggggaagttctcctggataatatcctgcagagtgttttccaacttggttccattctccgcctcactttcaggtacaccaatcagacgtagatttggtcttttcacatagtcccatatttattggaggctttgctcatttctttttattctttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagttttcaacttctttgcctttggtttgaatgtgctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgaggttttctctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctcagatggaaatgcagaaatcacccgtcttctgtgtcgctcacgctggagctgtagaccggagctgttcctattcggccatcttggctcctcccccctacactgaatcatttattttgagccagggcttgaagcagacaatccaagcatccttctaaactatcctcagtcttgtcaacagctgttatcttcagcttcttcaaggtatcactgagattatccatgttgctccccgagggtgaggaaccggcggggcgaggcgaaggtctctggtgcaggcggcgcggctctgtgtcctccctctacctccgtctctatttatttattttttaagagacaggtcctatgttacccaggctggtcatttacaggcacaatcattgtgcactatggcctcaagctcctgggctcaagcgatcttcccacctcagcttcccgagtagccaggagtacaggcacgtgtcaccatacctggcttccatttactttttaaaacaggtgaagagattttgagacccagaatgcatttgtgacttgcccaaagttacctggctagtaagtggcagagctaagcctagactctgtgtcttaagcatagttcaaggcgctttccacagagtgtagatggagtttcacattgttcatccagattccttaaggacctgaactcgctaatttgatctactaacctggaaattgactagggcttctcttataccactcagccctttaaagttttgccagtaaagtatcaacatggttaataatatgctgtaatttagagtacacaagccaatggacatacaaatttggtcattcagtagccacccagagagtgagcacagatacacactggagcagctgatttggcaagattggtggaggctgaacatattaactagtcattaaatgaatcatggtctttctgtcctcaacatttacaggattgctttggctctggcatctgttgttagtcaatactgattaaggacccacctattcttggtgataggtgttcattaaacattctaaatataccctgtcctcaagagaattccttactgggcctgggggttgttcctcctgcacccccacacaaaaagagacttccttctaataaaggcaagataaatatccaaataacacatgagaactgataatgacacatgcagccaatctgatgactgtgtagacttcattccatttagatctatagtttcacagaatcaagaattttattttttttccctccttttcattgttgttatgagccatgtaaggggactcattgtcccagggacgggtgtttgggagggggagatctttatggataccctttcttctcagtggcttattgctatttggcatactacagtacaatttgctagccaggaggagtttctggctgtagatcaaacttctccgctcatgcctggtgccagagagatgcttgctcttaagggggtggttactgctttgataagtgtgtggatttctgagtgacgtcattccactttggcacagacaggtatttatttctctagaatgaactaccaggggtgagccagactgtctgcctcagtcatttcccaaggtttcatttattttaaaaatctgctaacacatctgtgtgtatttttttttctctgtatgtttgtcatgtgctataattacttatagggcttctggtgacatcttaattaactagagaagaaaaaatcaaagatataattgtagagttgttcacaggtttttctatggactttgtggatccaactgtcaacatgatattgatggttacgaattctttttaagctgagaaacgtataaattttatgttcctcggtcattgatcacacctttgttctgtcttttacccttgctatggtgttttagtttaactgagtgaatgagtcagctcaggcctttgatgtgatcacagcctattttggggggctttcagggagcatatttaatacctaagtgcatttctaggcccttagttctatggattatattggggtggcattgtagcatgtagattgtaccaagagggtttaacagcctctttattcattcctccctatagttctgggaatgctagtgctaacacatgggatgtaaacaaagggaaggtcccaggtctacagaagctatagagagagctggtgggcaggcagattttctaagtcagccaaatcagggttttgcagtgggttcatccaagccaatgtacacacaagccacaagaccaggataagatgtgggttgtggctgatgcacagtttaggagcaggaaagccatgtcttggatccaggaagtctgcaaacatgggagaagcaggtcagaaaaaagaatgttgatccttttattcctagaatagtggctagcccataataggaggctcaattaatatttgttaaatgaatgaatgaaataagaagacatcagggactcagagaaggagcctggacaataagatatcagaaactaggcaagaaatgtggatggcagagattcaaatcttgtgtagacccccgtgtctggtcttatgggatccatagatctatcttaagagatatgaagaccctccatttgcctcctttctgctgtgagcaccgtgccataggggtggttgaaaggaaggcagaatctctcacttaacataaattgatggagacatttccagttagtgtctacgatagcttaaatttgggggccattcctagttctctgacctaacccacaagaaccttggtcctataatcattcaggaaatcgtgattaagcacttaatagatgtcagacatggtgctagtccagttctctacttcaaagcagattcctaaggtccggctcttgggcatgctgttctctcaagggtgtggttctgctccatggaactaatccagagccacaagaatcttattttcatacagtccttcccccaaacctgattataggggacaatttaggctattttgagaaggtgggtctaccactgcttgaatcctttctaatcatctgtctaggctaccgaagacaatttgtggtactcacttgtccctgaaaatttgaaagttcatttctccatatgtagactatattatttttgcctttggcacttttctctgtctctgaactctcctcctctgatctcattgctggcaacgctgaagccaaagctgtgataagcccagagaagtgtgcccgccccctgcctgcccgtctgtctttgaaagataccttcaggctgccgctgtactactgggtcacaaaaccagcatccaccattacaggcagaatcgttttcaagtcatttcctaccttggtgatttttaccccctccttcttttaacaccttccccagcaaatccaatccatcctctggcttatctgggtcagcaagggtctgattttatgcatgacactgtcagaccataaatccactgcagctttgcctctctatccagcctgcctgcttctgtcagcatcagcaaaatgcataatagagaaaataagccagaaaggctaataacactcatctgaataaaataatctctttggctgcctcagttcatttcattttaatcaaggtgccaggagggaatttaggttaaaaaatccaacctccttcttgtcacaagttccctgtccaaccatcacttaaatgattccttttatcatgcatgtacctttttttattcaccacatacttgtatgttcaataacatatattgaatgatgtatttaactctttaagttttgtctatcatcacagataggtctgtttttaaaagcgagaaattatattctgcttagatgtattgatagttgccatctctctatgcagattggcaggtttgataggaattctgagacaggggatgggagcttagtataagttgctgaagcatctagggtttgggcaatctgtgctccctttggattcctttctgtcaacctcagcacacagttcccagtgtggaatgcaggactgattgttctaccttgtcccttagggaaaggacagtgggagattaaaatctgctctcctgttggtatctctctcacgtcttcccagagccttacggctgctttgttaattgcctgttgctgctgtcttactcaaaccattatttgctgaaggctgtgcattttcagcaggcagcaatcttggccctggcccagagccgggtgagaagcatgttggaaattgatgaaagctgagtcctagtttgtttggaaataaaaataataatatttcttcacatttgtatagtgctgaactattggcatagttcttttgcatccatcatttcatttgatccacacaacagccctgagaggtgagcaacttagagactattggcccaaaaggaaacacacctcgttatagcaatgcagaagctcaagctatattccagcaatgccagcctcatgccatgcattccatctgcacagccatgaacgtagcaattattaattaaatggcaccttaggtcaggagagcgtctaggattttacagccatactttgaagatctttgaggagtgagatgtataccaatagggcacgtgtccattttatagatgagatgataaaaaccaaacagaggtgatatggaaaagaaccataatagagaggccaacttggacctttatagacttggctcttcaccatggatattttagagaaatccctttaagcgcttgttgctaagtttgttgaacgtccataaatagtccaagttgagggagaaaagctgggctaatgtcttcgaagctaatgattcagctatgcaggtttatctctttcagtgcatttacagtgataatgtctcctgcagatgtacaggcagcatgtgactttccgggtctcctttcgactccagagtcattccctctcaggtatagtatgatgttttcttgatcttcctcctgaaaaacattttaagtaagaaaaatactcctaggtattttgtctgctttttagggattagtgtttgaggaggtttgcagctgctcagcacattcctaagggatgcagaccctttcctttaaaggcccaagtattatacaacctaaggctctgggggtggggaaagtaaagagactgtgcaaacaaatgatagatggaaaagatataaagacaaatttcaatctcctaaccaaacgaagttcccttggcttcagcggtcccaaataaaatgaggctgcaaagcttctggagcaggaaaccactctagcagagccttaatatgctccctatgaaatcacgtctcgttgccgtgcttattttccagcctgaagtgtgtttcatctttgttcgtgttggctgggaaaattgtctgtatatttgtgatcccctcctcccactttctctctaccttacttgctctaccactacccaaaaataaataaatgaattaattgaaacacctcagttgaaaggaagaatatgtctgagaaagcttacagactcaaaggaccagaaatattgtgtgaaaagctgcattaatagtaggagaggctgagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgtttttatgaactaaaaatattgagatcaggattatgaatcagttatagttttatattcatttcagcatctggttttggtttaggtagtccaatatcaagaaaattctgattagcatagataagttattgtaatcttgagctttaaattgatttagatggaaaaaagaagatatttttgttttaaagttgagtcactatcatcacctagcagctattccccttcataaatattaattggataagccccaacatgtataataggcatcgcaacaactgatgatgagatggtatgatattaagcatgttgattttcgctacccaaccacggtctcacatgaacccagcctaggcccttgagccttctatggcatgtgattgaaccttgctgctgtgtgtcaagttataggctcacctgtacagctttattggaggaggcacacacaggcttgaatgaaaaaataaacctatgcaaagctacatgtattctaattaatagcatattgttcagaagttccaaggcatacagtgattctttcttccagggtttacataaaacaatgctagcagcctgcgagacattgcagtggtatctaatgcagggaaactgggtcctgggtctcttgctcatgtcagtgagggttgctcatttgaatggatgtgtcaccgttttttaaattgaaatgtgattttctgctaattccagagtatctcagaacacagtttaaaagctcctgctctctgaaaccaatactaatactgtaactatcgcacaaaatgctgtaaggatggaaataaatacatgtgaaaagtacttatagcaccttgcaagttcttttttcttttttttcttttgttttgagatggagtcttgctctcacccaggctggagtgcagtggcatgatctcagctcactgcaacctctgcctccggggttcaagtgattctcctgcctcagcctcccaagtagctgggattacaggtgtgcaccatccacactgaggtaattttgtatttttagtagagatggggttttgccatgctggccaggctggtcttgaactcttggtctcaagtgatccacctgccttggcctcccaaagtgctgggattgcaggcgtgagccacaccttacaagttctcaataaaacttattagcattaagtggtaaggcattttattttaaaagatttctacttccagccatcctgtttattgacccatctttgttcagtcatcttttcttttgaggacaccttggggatatgtgctctgcatcctttcccatggtgttaggttgattttgcctcctctgcttcctcttttgatctgcggtctacctttctgagctagctggccttttgtttgtaccaccattaaagttctactttactataggtctttctttgtctcccttactatattgcagcatttgcacttttataaccactaaagcacctaacaccatgccttgttcatttaagatacaaatgtgtgtacatttgtggaattgaattgtggcattatttgtgtgtatgtaaagtgctatagggaaagaaccagtatagatcccccccaatccatcttcttccttaagaaatagattgaaaccaattgtcaatgtaaagtctcatgagatctgcccctttaaaaagcatgcttactgaggacatgggtatcttgccgagagacaccacttgattaaaatgtaaattaggttatttagaattttgtaactgaaatctaattggaatcattttgaaagttttcttgcaatggagacatcagatgctatggaatgcatgtgttcaaatatcttaccattttgaatttaggattgtttccagttcacttttttttccccagatactaaacattttgaaaggagtaaattaattatgtgtctctcttcctctcagctggtatatttttgatttccatagaaatctttcagtttccctaaaaaggtaagtgttgtcacagtgattggcacgcttaagagttagtgattttggctacagaagagtgatgcctggggcagggggtgagtggtacccggatacaggtttagaacagtttcaatttggactctaatattaattggtttgaagtaacttcttggttgggttagacagatatttgatttgtctgatgtgttctgaagtccaagtaagtatggcatgattatttgttaatagttactactatagaattggaaaagccttctaagttgaacttcatggtttacaaatcacaagtgcctggtctttagtgctgaatggaggcagtactgactcaataaccaagctactctcaactcactttccttgtagtaggagtctgactggagcggagaagagaggaaagggggaaagaaacagatagttattatttgcagtgaatgagagtactcgctttgcagttataggcttggtttgaattctggaattgccactttttagctatatgaccttgggcaaagtgtttaaaaatttttagtctacttttcctcatcttccaaatgtggttaataacacccacctcatcaggtagttgtggggtttaagtcaaacaacatgtataaagggcccagatatgtgtacagtatcccttgataaatagtactgcaaattattcctacttttgtttctctccttaaagaaatccaacttccaaatgtagaactttctgttgcttaagttaatgctgagttggtaatcaataattcttttggatcacaatgttttcattagaaatgagcatctagggccgggcgcggtggctcactcctataatcccagcactttgggaggccaaggtgggtggatcacttgaggtcgggagttcaagatcagcatggtcaacatggtgaaaacccatctctactaaaaatacaaaagttagctgggcgtggtggcaggtgcctataatcccagctactagggaggctgaggcaggagaatctcttgaaagcgggaggcggaggttgcagtgagccaagattgtgccactgtactccagcctgggtgacagagtgagactttgtctcaaaaaaaaaaaaaaaaaaaaaaaaaagggaatgagcaccttggtttagcactttactgctccactcaagctgtagacattttaggaacacatgttcaggtatggtttgtgttcttgattgtatgggacatgagatcatggctcaataaatgaaatcaaaacttccttagatgtgttctgtggaactccagagttttcagtaacattttaatggcatatgtctccaaatttgcctttattaaatcctacaatggatacatttgtggggattttgtagtgctgtagtgatttttgtgtctagacaaaatctctaactttggtttctaaccctagggacaaaccaaatgacttagtggctaaaatgatggacttcagaatcaccttagacctggtctagccagacaatgcagaactgttgttctagtccctggcgccctcttacttgttgtgttagtcttactcgctgtagacaagtgacaacctctctgagcttcagttttctaatcagttgaagggggataatggtagttctttccttaaaatgaaatgatagagcttagatgagatgagataatacgtataaagcattcaccaagttcttagaacatagtaggtgcctaacagataatcctgtttctccttgtacatcccctcttccctccctctccttcttgtccttattttctccttttttctccactgagtttttagaaaaggagaaaactagagaggtgagcttcaggaaaaatatctttatttctggattggctttgattgctgtgattttaggacacggactatagttgtagatgttgccctggctgcgtatcaacaatgacttcttttccttgatgtttcttcacaggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttcttcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgtggagaaaaaaattatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttttgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggacccaattcaccttacctgtcaacgatggaaccagcctcttgaaaatccaggaagctcttttctaagctgtctcagcttgagctcaaagtggaatcatttattcatgaggttgggttacagacagcggtgaaggccccaaccattgtatatgatatgtcatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggactgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggctattattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatccgagaaaacaacttttataagatctgttcacctagctagacttcactcagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcatatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcataggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctggacaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgctctccagcctgggcaacagaatgagaccctgatagtttgaggatgcagtgagctgtaatcatgccactgcactccagcctgggcaacagagagagaccctgatggtttgaggatgcagtgagctgtaatcatgccactgcactccagcctgggcaacagagggagaccctgactcctaaaaaaaaaaaaattgattcattctcttttggctgggtaaagagcctctctgctttctagtaatgggcaaacaaacattcttcataccacaccccagttttttaacctcttttgtttagagtgtccttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattttaatcccacagataaggacaaacaaaagtggatataggtgtggagagggctagcttaagcaaatgaagaccagatttcttgaagaatgaaggattatttcaggtgctgatatctacaatgtcagcaataaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcaacatttttaaaaatctttttttaatctataaaacttaatgattcactgcaaaaattatgataatagaagtcattatattttgaacctctatgtgccaggtatcgtgttaagcactttatatgtattatctcctttaatccttaccgtaattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaacaaaaaacaaaaaacaaaaaacaaaacagagggctgggagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcacagatcatgctgttgcacttcagtctaggcaacagagcaagacttcgtctcagaaaaaaagaagagagagagagagattaagaaaaacgaaatgaagctaacgtttaactccagtcacctggctctagaatccaacattttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttacactcctcaggggcaaaatatctctgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctgggacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttgtttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatgacattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacagatgagtggaaaaacatattgtagtgtatccatatatcaatactactcagcaataagaagggaaatgctgatacaatataaatgagctcaaaaaacattatgctgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatacccatgccaagaccctaccccagcatgatttagtcagaatctctggagtagggcctgggtgattgttgcctacagctagggctgagaatcactgctgcactgttttccatcttggggaaactgcagagcacagagaatatctgatgccccaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggtcttggagatgttaaacgtgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccgtttggactgagataggatttcctatggcgtgtcttgagtccagctgtttggcatgtgtgagaagagtggatgatgaaactgtgagaaggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacagacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttaggaaggtgcagctcaaagggaatgtgtgcatcaaagatgtctgtagtcttttgcttaggttagtttgtgtgtttgcctttttggtgttttagttcttaggtatctgccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgattatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttaggttcttattattgcttacttgtatgtaatatatcatctttttgtttgtttgtttgtttgtttgtttgtttgttttaaagagatggagtctctgtcccccaggctggagtcctgttgcatgattacagctcactgtagactcaaacttctgtgctcaagcaatcccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaaatttttcctcaatttgagaaaaatttttggcaaatatttttttctgtcccatctctccttcctgttttgctttgttatcaattgcatgtatgttagactacttgattcagtcccacagcttgttaatgttctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacatgcctgtaatcccagctgctcaggaggccgaggcaggagaatcacttgaacccggaaggtggagtttgcaggaggctgaggcaggagaatcacttgaacccggaaggtggagtttgcagtgagctgagattgtgccactgcactccagcctgggagacagagcaagactccatctcaaaaaataaataaataaataaataaataaataaataaataaataaataaaacaaccaattctttcttttgttcacctaagatgctataaatgccatccaatgaattttttttatttcagatttttttttttttttttttttttttttgagatggagactcactttgtcacccaggttggagtacagtggtgtgatcatagctcaccctaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctccaaattattgtatggatatttttaaaacatagttggcaattacttaaaaattcttgtttgctatttttaacattgacattatctgtgggtctgtttattgattttcctcttgacttttttttacatgcctactaatcttttattgcatattggacatcatagataatatgtcatagaaactctagatgtacttatcttcctctgaagattatgaagttttattctaggaggctattaaattactggttgatcaccttgatcttgtgggggcttggctttatacttcattacagtgggtatattttggttttgcccttcgtcttagaaaatactgtatacttaaggcatggcctttctggggtttccatgggaaacccaagatgtttatcaagcccctctaacttggcaggctttgaatgccaaattctatcttccttacagtgggcagcacctaagacgaccaactatcctgtttgccttgggctgagggggttcctaggacatgagacttttagttttatctgttcaactgttgatggcatttggatagttttcagtttgaggctattatgtatgttataaataatgctgctatgaacattataatgggaagttattctttccagtgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaaaaacagatttattgtacatactattttgtaatctactgttttagtcaagaccttctcctttacatttcaataaacttttgtctcatctaatacccaggccatgtaaagatttaattaattactcaaaaaatctctttgacaactagtttgtccaagccagtatctaatgcacacagttttatgtcccttaagtgtactttaatctagtattattttctttccatgaaactgatttgttgaagagaccaagccagatgtcctgcaaaatctcccatcttctagatttgtctggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcatctgataattttagtatcagttgataattttagacaagttactttttgtcatctctgtacctctcttacttgactataagatgcctctctgaggctgggcacagtggcttatgtctgtaatcccagcactttgggaggtggaggcaggtggatcacctgaggtcaggagtttgagaccagcctgaccaacatgctgaaaccctgtctctactaaaaatacagaaattagccaggcgtcgtggtgtattcctgtaatctcagctactcaggaggcttagggaggagaatcacttgaacctgggaggcagaggttgcagtgagccaagattgtgccattgcactccagcatgggtgacagagcaaaactccgactcaaaaaataaataaataaataaataaaataaaaatgcctctctgagaaaaggagaggattgttaatacagctcatcaggcaccatgcaaatagtagtttgtaaaaacgtattagtcttgggagaaaccacacacacgaatagtgtgcaagctgacaaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatacgttgctgtgcttctgtcaggtcagaatttccattgtgctattctgattctgcttcttgcccagcttgtccagagagagagtaacacctttgactttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttctttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaatttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacattttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccatagctttttcatatattccttatggttctttggctatgttgtctttttttttttttttttttggagatggagtttctttttttcaggctggagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagttgagaatcagtgctacgcctgagcctgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggcgatccagtctccaactttaatcatctcttctccaaagccaagataatccaagccatctgaccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtaagtcaggagagcttcatagaggggaaagaattgggccgatgttattttaattacctgcttccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctttggagatggtgagaagtggtcaaattctgggatatattttgaagatggagccaataggatttgctgcttgattgatatggtgtatgaaaaaaatagcagtcaaagatgaccccaagcattctggcctgaacgattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctatgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaaaaatttgactttcccagactcccatgtgcccatctataaactgaacaagaagcatacttcttgcccactttgcctcctggagatcctgtgaggataacaatgacaaaggataggaaactgctttggaagagaaatgttacataaatcaagatatccttttctagctgactttaagtttttaatttaagaaaaattcttgaaagagtcacaaaaaactttactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcagatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcgttttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacattatgtttcctcaatacacagtgaattgagttctgactctctggggcagatagatttctgactttctgggccatgtgttgaaaatatgaagatggctgacgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataataggtgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataatcacagtacaatgatcaaaatcaggaaattaacacagaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatgattggattcagtttaagcaattttggcaagaacaccgtagaagcgatgtcatatttttcttagtgcgttatatcaggaggcacttgccgttgatttgtccccattactgatggtgataattttaattactcggtgaggatgggtgtcccctttgcactgtaataaatgtcttgtgaagatactatgtaaatatcctatttctcctcatcctttgcttactaatttttagcatgcttgttaactgaaacaattctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctctttttttttttttttttttttttgagatggagttttgctcttgttgcccaggctggagtgcagtgcgcgatcttgactcactgtaacccccgcctcccaggttcaagtgattctcttgcctcagcctcccgagtagctgggattatagtatgtgccaccatgcctggctaatttttgtatatttagtagagacagggtttcactatgttggccaggctagtctcgaactcttgacttcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttccccaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacatagccctttgaatatttttctgccgctgctgatgtgagctgattaaactggcaggcagatgatggaaggaatagttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctattttttctagttctgcattctagaaacagtactgatgagtccaaaaatatagagataaaattttgtcttttttcttgctttaaaaaaaaatgcttctaaatgtctacatacttgcctaagaaaatatttctcaactcctccagaatatttagggttaactaaaaattataaaaacataccacagagctagtccactctttatgcctagggtttacccaaaaggtctgcatgctctggcttggagaccctgaccccatctcaacttgctggtttcaagtctacatatttggctgcaaagccctaatgccaggaggaatgcggaactgacgagtccaccccatctacaagctagaaggacatcttgattaaattagtgtcaagggcagtggagagaaaggcacagtgacacaaagggtgttttgaggagccctgtagcgcctgtggagaatgaatgttcttgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatgggatttaaagcaaatctaaagctgattgagttttagatttctttcctttaaccagaatattctagcagcttatttttatagttctgcttatatgattctctttttaacagatggaatcacaaccttttctgcagaatatatctgatgaatttaaaaactgatacatcaagaatattcttttgtatatgtctttcttgctgtgaaaatttatggcctttcttccccctatcttcgctctgtaattattaggtgcttactatatgcaaggcattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctggatttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttctgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagtgattacttctttcaatttttttatgctagtgtcacttaggaaaagccagtgtgctgttacagaatttgaggtggctggtgaagctgacattttcacatgtctcacgaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaatgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatggaaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcattatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgagattaaattataaaaacaaacctggaaataataaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttacaactcagcaacaaaaagatgaccagtccagtttaaaaatgggcaaaagacttgaataggcatttctccacagaagatacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtgagattgtaaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcgccactgcactccagcctgggcgacagagcgagactccatctcaaaataaataaataaataaataaataaataaataaataaataaataacaaaaagtggaagcaacccaaatgttaatgaagtgatttatggaacaaacttaaacaaagtatggcatacctatacaatttaaacaaaatgtgtcatgtccatacaatagagtagtatttagtcataaaaaagaaggaagtgctgatacatgctacaatatggatataccctgaaaacattataagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgacttttcttttggcatgattaaatattcgggacttagtggtggtggttgtacaaccttgcaaatatactaatagccactgaattgtgtaccttgtagtggtgaattgtacagtgtgtgaattatatctcaataatttaaaaaatcaaacaaattttagtacaaaaaatgcagtaactaaaagagctcaatgtgtagatcaagtagcagattagatggtgctgaataaataattaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctggacaaaagcaatggaaagcagatgacagtggaatgaaagtgtagaaaggaatacccttcaaaaatgaaggtgaactaaagatgttttcagacaagaaaaatatgagaaaatatatcaccagcagacttgcactaaaagaaatactaaatggcattatttaggcagaaggaaaatgatcccaaatagaatcttagaaatgcagtaaagaatgaggagcaacagcaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctgtagtcccagctacttgggaggctgaggcaggagaatggcgtgaagccgggaggcagagcttgcagtgaaacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggccttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttctttctttcttttctttctctctctctctctttctctctctctctgcccccccacttctttctttctgtcctttttttttctttctttttttttttttttctgagtcttgctctgtcacccaggctggagggcagtagtgcaatctcagctcactgcaacctctgcctcctgggttcaagcagttctcccacctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtattttttgttataaagagagacatttccaggctgggcatggtggctcactcctgtaatcacagcactttcggaggccgaggcaggcagatcacttgaggtcaggagttcgagatcatcccggccaaaatagtgaaactctctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagtgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccctaatgagagatttaacacacctgtctcagtgaatgattaaacaactagaccaaaaaagtcagtaaaaatacaacaaacttgacctaaatgacatatatggatactgcgcctgacaactgcgggtagatacacattcttttttttttttttttttttgagacggagtttcgctctgtcaccgaggctggagtgcagtggtgcgatcttggctcactgcaagctccgcctcccgggttcacgccattctcctgcctcagcctcccgaatagctgggactacaggcgcccgccactacgcccggctaactttttttttgtatttttagtagagacggggtttcaccttggtctcgatctcctgacctcgtgatccgcccgcctcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgacgaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgagctctcgtgttgcctgtttgcttttgtgtcttttgtcccttatgtcccagtctactcaaggttacccacagtcacctagataccatttctactctgtgcttttagtgtcctgcttgggaaatggggtgatcactcatcttcagaatgacctcaagaaatgctttggcatgagagatcagggcctgaagacattacgcccccagccaaatcattatccaaaagggtaaaagatggaaatttgccaagacaaagatcacagtggtagtttaagaaatgaaagcttagatttgattgtctgttttaagggatgttgttttgagtttattttcttagtattaggataggtcattcaaagagattggaacaaccatggaagaacattcagattattataggactgtgtttcagactgggagagcagagggccgttatcctcttcctgaccccaccctgaactcccctgaactcccacccttgtcccgagtatgcctgtccctgacaagagactttggtcagggaccaaagtgagctttgttagtgagcattcacagagggtaggagctgagtccacgaagttcacatcatgccaaggaatggatttcctcccagggccactagcattacttgtgggttatcaagtgttactgctcacacattccagagcttctagaaaagccgtaaggaaatggctttcagaaagccatttctgtcctagaggagagaggtcctggatttcactgaaccagaacttgatgggtggttttggtattctgtgacctaggtagtggggagccccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcatctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcagcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaatgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaaggtaaaacctatctcttccattagctttagatggtttcatattgtagttgctttgagatttttttagactaagtttttcagataattaaacaggaatcaaattcaaaaactattcatattccagaagaggaatcctgaaacaggtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaacccaaagaaaaagaatttactatgtaatagctggattttttgaaatcagattttttttttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaataaatgttctataaatatttgctgatggactctttattgcttactccctaaaatccagccatttctcccttgccagcattcaataattgaacctgctttgaaacatctgatcagccacttcaagacggcaagttattttagctcctgtctaactaagttagtgggctccagtccttaaaccactattttctttattaattcctcaagtacagacttttgtatgtaaccagtcttcttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattacaaaaattaaccagcgtgtttgtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaaagaagataaaaaaataggaaatatcatagtggacagcacataagtagaggtgaagccagctggacttcctcagtggagtggggacttggagaacttttctgtctagctagaggattgtaaatgcaccaatcagcactctgtaaaaacgcaccaatcagcgctctgtgtctagctaaaggattgtaaatgcaccaatcagcactctgtaaaaatgcaccaatcagtgctctgtgtctagctaaaggattgtaaatgcaccagtcagcactcttaagagctgtaacactcaccgcgaaggtccacagcttcattcttgaagtcagtgagaccaagaacccaccagaaggaaccaactccggacacataagtacttttattatagacacctattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcaccgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtagaagctgttgcaatctcattgtcttctgatcagcccctcggcagcagtcagagtggaggccagtgaagcactctggccaaatggttgtggtgagtttcaaaataagagatcccagcctgagcacaccatcacacttcccatccgatagaaccagcattgttaactgtaccacatctctattctaaatttaggcatcttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtattcccagcccaaccctcagccagagggagcagtaagtcagatcacttcagcagcctgttcaaataaacagggataatagttgagtggtcctcccaactcatcagtacatgaaaggaaacatctgcctgggcttaattgctgttttttttggttacacttttccctcctcttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggaaaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggtttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttaggatggcattttgatacccgaatttctggtaggaaagatctagaaggagctggcaaaagataaaacaagggctttccctctcaatgacccatgctgccaatcagttttagctctcttaggtttggcatagaacacttagtatagaaggtgtgacaatttccttcctgcttcctcctttctttcctttccttttcttttcttttttttgagacagagtctcactcttgtcacccaggctggagtgcaatggcgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccacctcggcctctcaaagtgctgggattacaggtgtgagccaccgtgcccagccctcattgtttatttctactgctctatgtagttagatgtcagccctgggtggcagcagcaaagaacccaggagccatcactgctcaagattaactagttggagaccccttaacatatattttcagcatctagtaacagctaatctctcaggcagtcaatattgagataccgctgccttgtgagttttgggtagaaataaagcaagtaagaaatatagttccatcctgcttggagttttctatttagttagggactttgaagtccctgaatgtttatatactttttcctatttcatcccattacacatcttactttcctttgaaatcttctggaatgcttgactgcaagtatctgagaaaccatgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgccttcgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccccgttagcagcaaaccagggaccctgaactaatggcaaggaacgtagcctgcattgcactattaatatgtgcctgtcggaaaggctttattgttctaggtttttcatcagatcttggattgatgtatggctttgagactagaacaaatgctctagagggcagcacagagtcctaaatgcccccagtaagagggaccagtttgagcagagagagctttgcactggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgctatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgttttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggtttttaaaatagaaacacatcgatgtgagccattttcagactggatgggtttcctgaaccttgtctttttaatgctttacttctgctcttttagatcaatttctaagcgccaagaagagctattactcctttctcctagcagagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
